(12) United States Patent
Widschwendter et al.

(10) Patent No.: US 8,367,336 B2
(45) Date of Patent: Feb. 5, 2013

(54) ASSOCIATION OF THE DNA METHYLATION PROFILE OF THE CYP1B1 GENE WITH RESPONSE TO ADJUVANT THERAPY IN BREAST CANCER

(75) Inventors: Martin Widschwendter, Tonbridge (GB); Kimberly D. Siegmund, San Marino, CA (US); Peter A. Jones, La Cañada, CA (US); Peter W. Laird, South Pasadena, CA (US)

(73) Assignee: University of Southern California, Los Angeles, CA (US)

( * ) Notice: Subject to any disclaimer, the term of this patent is extended or adjusted under 35 U.S.C. 154(b) by 403 days.

(21) Appl. No.: 11/628,390

(22) PCT Filed: Jun. 1, 2005

(86) PCT No.: PCT/US2005/019375
§ 371 (c)(1),
(2), (4) Date: Dec. 5, 2007

(87) PCT Pub. No.: WO2006/004597
PCT Pub. Date: Jan. 12, 2006

(65) Prior Publication Data
US 2009/0136921 A1    May 28, 2009

Related U.S. Application Data

(60) Provisional application No. 60/576,284, filed on Jun. 1, 2004.

(51) Int. Cl.
*C12Q 1/68*    (2006.01)
*C12P 19/34*    (2006.01)

(52) U.S. Cl. ...... 435/6.11; 435/6.1; 435/6.12; 435/6.14; 435/6.18; 435/91.2

(58) Field of Classification Search .................. None
See application file for complete search history.

(56) References Cited

PUBLICATIONS

Widschwendter et al (Cancer Research. Jun. 1, 2004. 64: 3807-3813, supplemental data 1 and 2.*
Smiraglia et al. Human Molecular Genetics. 2001. 10: 1413-1419.*
Ushijima et al. Nature Reviews. 2005. 5: 223-231.*
Rush et al. Blood. 2001. 97:3226-3233.*
Toyota et al. Cancer Research. 1999. vol. 59: 4535-4541.*
Cameron et al. Blood. 1999. 94: 2445-2451.*
Rush et al. Blood. 2001. 97: 3226-3233.*
Pu et al., Methylation profiling of benign and malignant breast lesions and its application to cytopathology, Modem Pathology 16:1095-1101, 2003.
Lehmann et al., Quantitative assessment of promoter hypermethylation during breast cancer development, Amer. J. Pathol. 160:605-612, 2002.
Jeronimo et al., Detection of gene promoter hypermethylation in fine needle washings from breast lesions, Clin. Cancer Res. 9:3413-3417, 2003.
Crewe et al., Metabolism of tamoxifen by recombinant human cytochrome P450 enzymes: formation of the 4-hydroxy, 4'-hydroxy and N-desmethyl metabolites and isomerization of trans-4-hydroxytamoxifen, Drug Metabolism and Disposition 30:869-874, 2002.
Nakajima et al., Effects of histone deacetylation and DNA methylation on the constitutive and TCDD-inducible expressions of the human CYP1 family in MCF-7 and HeLa cells, Toxicology Letters 144:247-256, 2003.
Rush, Global and gene-specific DNA methylation analysis in human leukemia, online publication from http://www.ohiolink.edu/etd/send-pdf.cgi?osu1046352386, pp. 73-74, 2003.
Widschwendter et al., Association of breast cancer DNA methylation profiles with hormone receptor status and response to tamoxifen, Cancer Res. 64:3807-3813, 2004.

* cited by examiner

*Primary Examiner* — Carla Myers
(74) *Attorney, Agent, or Firm* — Barry L. Davison; Davis Wright Tremaine LLP

(57) ABSTRACT

Particular embodiments provide novel and clinically useful DNA methylation predictors of hormone receptor status, and predictors of response to endocrine (e.g., hormonal) and non-endocrine breast cancer therapy. The ESR1 gene, encoding the estrogen receptor (ER) alpha proved to be the preferred predictor of progesterone receptor (PR) status, while methylation of the PGR gene, encoding PR, was the preferred predictor of ER status. ESR1 methylation outperformed hormone receptor status as a predictor of clinical response in patients treated with antiestroges (e.g., tamoxifen), while promoter methylation of the CYP1B1 gene, encoding a tamoxifen and estradiol metabolizing cytochrome P450, predicted response differentially in tamoxifen-treated and non-treated patients. High levels of promoter methylation of the ARH1 gene, encoding a RAS-related small G-protein, were shown to be preferred predictors of better survival in patients who had not received tamoxifen therapy.

6 Claims, 3 Drawing Sheets

ASSOCIATION OF THE DNA METHYLATION PROFILE OF THE CYP1B1 GENE WITH
RESPONSE TO ADJUVANT THERAPY IN
BREAST CANCER

CROSS-REFERENCE TO RELATED APPLICATIONS

This application is a United States nationalization, pursuant to 35 U.S.C. 371, of PCT/US2005/019375 filed 1 Jun. 2005 and entitled ASSOCIATION OF BREAST CANCER DNA METHYLATION PROFILES WITH HORMONE RECEPTOR STATUS AND RESPONSE TO TAMOXIFEN, which claims the benefit of priority to U.S. Provisional Patent Application Ser. No. 60/576,284, filed 1 Jun. 2004, entitled ASSOCIATION OF BREAST CANCER DNA METHYLATION PROFILES WITH HORMONE RECEPTOR STATUS AND RESPONSE TO TAMOXIFEN, and which is incorporated by reference herein in its entirety.

FIELD OF THE INVENTION

Particular aspects relate generally to DNA methylation and hormone receptor biology, and particularly to prognostic and diagnostic methods relating to cancer (e.g., breast cancer), and to methylation marker-based methods for predicting response to endocrine (e.g., antiestrogen, tamaoxifen, etc.) and non-endocrine cancer therapy, particularly breast cancer therapy.

BACKGROUND

Breast cancer is the most common malignancy among females in most western countries, who have an overall lifetime risk of more than 10 percent for developing invasive breast cancer (Feuer, et al., *J Natl Cancer Inst*, 85:892-897, 1993). Early detection is crucial to successful treatment, and various approaches are being developed in the art for breast cancer diagnosis and/or for determining responsiveness to treatment. Such approaches include: determination of hormone receptor status (e.g., positivity); gene expression profiling (mRNA/cDNA); and DNA methylation marker characterization.

Hormone receptor status. Clinical and epidemiological studies have previously suggested that breast cancer is comprised of at least two distinct groups based on hormone receptor status (Potter, et al., *Cancer Epidemiol Biomarkers Prev*, 4:319-326, 1995; Fox, M. S., *Jama*, 241:489-494, 1979). The presence of estrogen receptors (ER) and/or progesterone receptors (PR) is an important diagnostic feature of breast cancer, both reflective of disease etiology (Potter, et al., *Cancer Epidemiol Biomarkers Prev*, 4:319-326, 1995), and predictive of response to treatment with the antiestrogen tamoxifen (Anonymous, *Lancet*, 351:1451-1467, 1998; Bardou, et al., *J Clin Oncol*, 21:1973-1979, 2003).

However, even with knowledge of hormone receptor status, considerable controversy currently exists as to which breast cancer patients will benefit from antiestrogen (e.g., tamoxifen) treatment. Antiestrogens primarily function through their ability to compete with available estrogens for binding to ER. However, the consequences of occupying, for example, ER with an antiestrogen appear dependent upon the cellular context, which ER is occupied (ER α and/or ER β), and perhaps the structure of the ligand (Clarke et al., *Phamacological Reviews*, 53:25-72, 2001; Cellular and Molecular Pharmacology of Antiestrogen Action and Resistance).

Expression profiling. More recently, molecular profiling of breast cancer using gene expression (cDNA) microarrays to determine gene expression profiles has led to a further refinement of the subclassification of breast cancer into five major distinct subtypes/clusters, comprised of one basal-like, one ERBB2-overexpressing, two luminal-like, and one normal breast tissue-like subgroup (Sorlie, T., et al., *Proc Natl Acad Sci USA*, 100:8418-8423, 2003). Such expression profiling studies have also led to the identification of gene expression signatures associated with prognosis (Perou, et al., *Nature*, 406:747-752, 2000, Sorlie, et al., *Proc Natl Acad Sci USA*, 98:10869-10874, 20015-9).

Molecular profiling in breast cancer has, however, thus far focused primarily on the use of cDNA microarrays, which are limited by the innate instability of RNA and are poorly compatible with formalin fixation and parafilm embedding of tumor tissues, typically used in routine histopathology.

DNA methylation/Gene silencing. Significant progress has been made in recent years towards the implementation of DNA methylation markers as clinical tools in cancer detection and diagnosis, and DNA methylation markers provide an alternative approach to molecular profiling (Laird, P. W., *Nat Rev Cancer*, 3:253-266, 2003). Hypermethylation of promoter CpG islands, frequently observed in breast cancer (Yan, P. S., et al., *Cancer Res*, 61:8375-8380, 2001, Yang, X., et al., *Endocr Relat Cancer*, 8:115-127, 2001, Widschwendter & Jones, *Oncogene*, 21:5462-5482, 2002), is often associated with transcriptional silencing of the associated gene, thus providing a DNA-based surrogate marker for expression status (Jones & Baylin, *Nat Rev Genet*, 3:415-428, 2002).

Microarray-based methods of DNA methylation analysis are, however, hampered by modest quantitative accuracy, poor sensitivity to low levels of CpG island hypermethylation and technical challenges in target DNA preparation, which requires either bisulfite-PCR-amplification of each individual locus (Adorjan, et al., *Nucleic Acids Res*, 30:E21, 2002), or the use of restriction enzyme digestion (Yan, P. S., et al., *Cancer Res*, 61:8375-8380, 2001), which is not consistently reliable with formalin-fixed tissues.

Tamoxifen. Tamoxifen was introduced over 25 years ago, and has been the mainstay of the endocrine adjuvant treatment of breast cancer. Tamoxifen has become the most widely used anticancer drug, and may be considered one of the first targeted therapies (Jordan, V. C., *Nat Rev Drug Discov*, 2:205-213, 2003). Tamoxifen, an 'anti-estrogen,' is a selective estrogen-receptor modulator, and has been shown to dramatically reduce the risk of breast cancer (Powles, T. J., *Nat Rev Cancer*, 2:787-794, 2002) and of breast cancer recurrence (Jordan, V. C., *Nat Rev Drug Discov*, 2:205-213, 2003). TAM is a classical partial agonist and exhibits both species and tissues specificity for inducing either an agonist or antagonist response. In rats and humans, it exhibits partial agonism (e.g., producing antagonist effects in the breast, but agonist effects in the vagina and endometrium. Long-term TAM use is generally associated with a reduced incidence of contralateral breast cancer (antagonist), a reduced incidence of primary breast cancer in high-risk women (antagonist), maintenance of bone density (agonist), and increased risk of endometrial carcinomas (agonist). Other antiestrogens are known in the art, and some of these also act through the ER.

Breast Cancer Treatment. Assessment of a patient's condition relative to defined classifications of the disease is typically the first step of any breast cancer treatment, and the value of such assessment is inherently dependent upon the quality of the classification. Breast cancers are staged according to size, location and occurrence of metastasis. Methods of treatment include the use of surgery, but additionally include radiation therapy, chemotherapy and endocrine therapy, which are also used as adjuvant therapies to surgery. Generally, more aggressive diseases are regarded as requiring treatment with more aggressive therapies.

Although the vast majority of early cancers are operable, (i.e., the tumor can be completely removed by surgery), about one third of the patients with lymph-node negative diseases and about 50-60% of patients with node-positive disease will develop metastases during follow-up. Based on this observation, systemic adjuvant treatment has been introduced for both node-positive and node-negative breast cancers. Systemic adjuvant therapy is administered after surgical removal of the tumor, and has been shown to reduce the risk of recurrence significantly. Several types of adjuvant treatment are available, including, but not limited to: endocrine treatment, also called hormone treatment (for hormone receptor positive tumors); different chemotherapy regimens; and antibody and antibody-based treatments, based on novel agents like Herceptin™ (HER-2-specific antibody).

The growth of the majority (about 70-80%) of breast cancers is dependent on the presence of estrogen. Therefore, one important target for adjuvant therapy is the removal of estrogen (e.g., by ovarian ablation), the blocking of its synthesis or the blocking of its actions on the tumor cells, either by blocking the receptor with competing substances (e.g., Tamoxifen) or by inhibiting the conversion of androgen into estrogen (e.g., aromatase inhibitors). This type of treatment is referred to in the art as 'endocrine treatment.' Endocrine treatment is thought to be efficient only in tumors that express hormone receptors (the estrogen receptor (ER), and/or the progesterone receptor (PR)). Currently, the vast majority of women with hormone receptor positive (HR+) breast cancer receive some form of endocrine treatment, independent of their nodal status. The most frequently used drug in this scenario is Tamoxifen.

However, even in hormone receptor positive patients, not all patients benefit from endocrine treatment. Adjuvant endocrine therapy reduces mortality rates by 22% while response rates to endocrine treatment in the metastatic (advanced) setting are 50 to 60%.

Because Tamoxifen has relatively few side effects, treatment may be justified even for patients with low likelihood of benefit. However, these patients may require additional, more aggressive adjuvant treatment. Even in earliest and least aggressive tumors, such as node-negative, hormone receptor positive tumors, about 21% of patients relapse within 10 years after initial diagnosis if they receive Tamoxifen monotherapy as the only adjuvant treatment (*Lancet.* 351:1451-67, 1998; Tamoxifen for early breast cancer: an overview of the randomized trials; Early Breast Cancer Trialists' Collaborative Group). Similarly, some patients with hormone receptor negative disease may be treated sufficiently with surgery and potentially radiotherapy alone, whereas others may require additional chemotherapy.

Several cytotoxic regimens have shown to be effective in reducing the risk of relapse in breast cancer. According to current treatment guidelines, most node-positive patients receive adjuvant chemotherapy both in the US and Europe, because the risk of relapse is considerable. Nevertheless, not all patients do relapse, and there is a proportion of patients who would never have relapsed even without chemotherapy, but who nevertheless receive chemotherapy due to the currently used criteria. In hormone receptor positive patients, chemotherapy is usually given before endocrine treatment, whereas hormone receptor negative patients receive only chemotherapy.

The situation for node-negative patients is particularly complex. In the US, cytotoxic chemotherapy is recommended for node-negative patients, if the tumor is larger than 1 cm. In Europe, chemotherapy is considered for the node-negative cases if one or more risk factors is present, such as: tumor size larger than 2 cm; negative hormone receptor status; tumor grading of three; or age <35. Generally, there is a tendency to select premenopausal women for additional chemotherapy whereas for postmenopausal women, chemotherapy is often omitted. Compared to endocrine treatment, in particular that with Tamoxifen or aromatase inhibitors, chemotherapy is highly toxic, with short-term side effects such as nausea, vomiting, bone marrow depression, as well as long-term effect, such as cardiotoxicity and an increased risk for secondary cancers.

Tamoxifen treatment responsiveness. Hormone receptor (HR) status, defined as either ER and/or PR positivity, has been shown to predict response to tamoxifen treatment (Anonymous, *Lancet,* 351:1451-1467, 1998, Bardou, et al., *J Clin Oncol,* 21:1973-1979, 2003). Interestingly, although tamoxifen is thought to act through the ER, PR status is an independent factor predictive of adjuvant endocrine treatment benefit (Bardou, et al., *J Clin Oncol,* 21:1973-1979, 2003).

Need for improved diagnostic and prognostic assays. While the individual approaches described above (hormone receptor status, gene expression profiling, and DNA methylation markers) have provided real benefit in cancer treatment, an even greater benefit could be attained through a better understanding of possible interactions between DNA methylation and hormone receptor biology.

There is, therefore, a pronounced need in the art to investigate and characterize the degree of interaction between DNA methylation and hormone receptor biology in cancer, and particularly in breast cancer. There is a pronounced need in the art for novel methods for determining hormone receptor (e.g., ER and PR) status in cancers, particularly breast cancer.

There is a pronounced need in the art for novel prognostic methods indicative of disease progression and/or survival in breast cancer patients. There is a pronounced need in the art for novel predictive methods indicative of clinical response to therapy in breast cancer patients (e.g., patients treated with endocrine (e.g., tamoxifen) therapy). There is a pronounced need in the art for novel methods that are both prognostic and predictive of response in and non-treated and tamoxifen-treated breast cancer patients. There is a need for novel methods allow for better selection of patients for chemotherapy or other, more aggressive forms of breast cancer therapy.

SUMMARY OF THE INVENTION

Particular aspects of the present invention describe and disclose a surprising degree of interaction between DNA methylation and hormone receptor biology in breast cancer cells, and provide clinically useful novel DNA methylation predictors of response to hormonal and non-hormonal breast cancer therapy.

DNA methylation profiles of 148 human breast tumors, generated using 35 methylation markers, revealed a surprising degree of interaction between DNA methylation and hormone receptor biology in breast cancer cells, and significant differences in hormone receptor status between clusters of DNA methylation profiles. Particular embodiments provide novel and clinically useful DNA methylation predictors of hormone receptor status, and predictors of response to hormonal and non-hormonal breast cancer therapy. The ESR1 gene, encoding the estrogen receptor (ER) alpha proved to be the best predictor of progesterone receptor (PR) status, while methylation of the PGR gene, encoding PR, was the best predictor of ER status. ESR1 methylation outperformed hormone receptor status as a predictor of clinical response in patients treated with the antiestrogen tamoxifen, while promoter methylation of the CYP1B1 gene, encoding a tamoxifen and estradiol metabolizing cytochrome P450, predicted response differentially in tamoxifen-treated and non-treated patients. High levels of promoter methylation of the ARHI gene, encoding a RAS-related small G-protein, were strongly predictive of better survival in patients who had not received tamoxifen therapy.

Methods for predicting response to endocrine therapy. Particular aspects of the present invention provide a method for predicting response to endocrine treatment (e.g., tamoxifen) of a cell proliferative disorder of the breast tissue (e.g., breast cancer), comprising: treating genomic DNA, or a portion thereof, with one or more reagents (e.g., bisulfite) suitable to distinguish between cytosine and 5-methylcytosine bases; and determining (e.g., by using Real-Time detection probes), based on the treating, a methylation state of at least one CpG dinucleotide of at least one gene sequence selected from the group consisting CYP1B1, ESR1, contiguous portions thereof, and sequences complementary thereto, wherein predicting a response to endocrine treatment of the cell proliferative disorder based on the determined methylation state is, at least in part, afforded.

Methods for prognosis of a cell proliferative disorder of the breast tissue. Additional aspects of the present invention provide a method for prognosis of a cell proliferative disorder of the breast tissue (e.g., breast cancer), comprising: treating genomic DNA, or a portion thereof, with one or more reagents (e.g., bisulfite) suitable to distinguish between cytosine and 5-methylcytosine bases; and determining (e.g., by using Real-Time detection probes), based on the treating, a methylation state of at least one CpG dinucleotide of at least one gene sequence selected from the group consisting of ARHI, CYP1B1, ESR1, contiguous portions thereof, and sequences complementary thereto, wherein prognosis of the cell proliferative disorder of the breast tissue based on the determined methylation state is, at least in part, afforded. In particular embodiments, the determined methylation state is that of at least one CpG dinucleotide of ARHI, the subject is not endocrine treated, and a favorable prognosis is positively correlated with the extent of CpG methylation. In alternate embodiments, the determined methylation state is that of at least one CpG dinucleotide of CYP1B1, the subject is not endocrine treated, and a favorable prognosis is negatively correlated with the extent of CpG methylation. In additional embodiments, the determined methylation state is that of at least one CpG dinucleotide of CYP1B1, the subject is endocrine treated (e.g., tamoxifen), and a favorable prognosis is positively correlated with the extent of CpG methylation. In further embodiments, the determined methylation state is that of at least one CpG dinucleotide of ESR1, the subject is endocrine treated, and a favorable prognosis is positively correlated with the extent of CpG methylation.

Methods for determining hormone receptor status of breast tissue. Further aspects of the present invention provide a method for determining hormone receptor (HR) status of breast tissue (e.g., breast cancer), comprising: treating genomic DNA, or a fragment or portion thereof, with one or more reagents (e.g., bisulfite) suitable to distinguish between cytosine and 5-methylcytosine bases; determining (e.g., by using Real-Time detection probes), based on the treating, a methylation state of at least one CpG dinucleotide of at least one gene sequence selected from the group consisting of BCL2, PGR, RASSF1A, SOCS1, GSTP1, PTGS2, TGFBR2; and further determining, based on the methylation state, a positive or negative hormone receptor status, wherein a positive hormone receptor status corresponds to a presence of estrogen receptor (ER), progesterone receptor (PR) or both, and is determined based on: a positive correlation with CpG methylation within RASSF1A, SOCS1, GSTP1, PTGS2, TGFBR2; a negative correlation of CpG methylation within BCL2, PGR; or both. In preferred embodiments, determining a methylation state is of the methylation state of at least one CpG dinucleotide of SOCS1, and a positive hormone receptor status is determined based on a positive correlation with CpG methylation.

Methods for determining estrogen receptor (ER) status of breast tissue. Yet further aspects of the present invention provide a method for determining estrogen receptor (ER) status of breast tissue (e.g., breast cancer), comprising: treating genomic DNA, or a fragment or portion thereof, with one or more reagents (e.g., bisulfite) suitable to distinguish between cytosine and 5-methylcytosine bases; determining (e.g., by using Real-Time detection probes), based on the treating, a methylation state of at least one CpG dinucleotide of PGR; and further determining, based on the methylation state, a positive or negative estrogen receptor (ER) status, wherein a positive ER status is determined based on a negative correlation of CpG methylation within PGR.

Methods for determining progesterone receptor (PR) status of breast tissue. Additional aspects of the present invention provide a method for determining progesterone receptor (PR) status of breast tissue (e.g., breast cancer), comprising: treating genomic DNA, or a fragment or portion thereof, with one or more reagents (e.g., bisulfite) suitable to distinguish between cytosine and 5-methylcytosine bases; determining (e.g., by using Real-Time detection probes), based on the treating, a methylation state of at least one CpG dinucleotide of ESR1; and further determining, based on the methylation state, a positive or negative estrogen receptor (ER) status, wherein a positive ER status is determined based on a positive correlation of CpG methylation within ESR1.

DETAILED DESCRIPTION OF THE INVENTION

Figure 1:
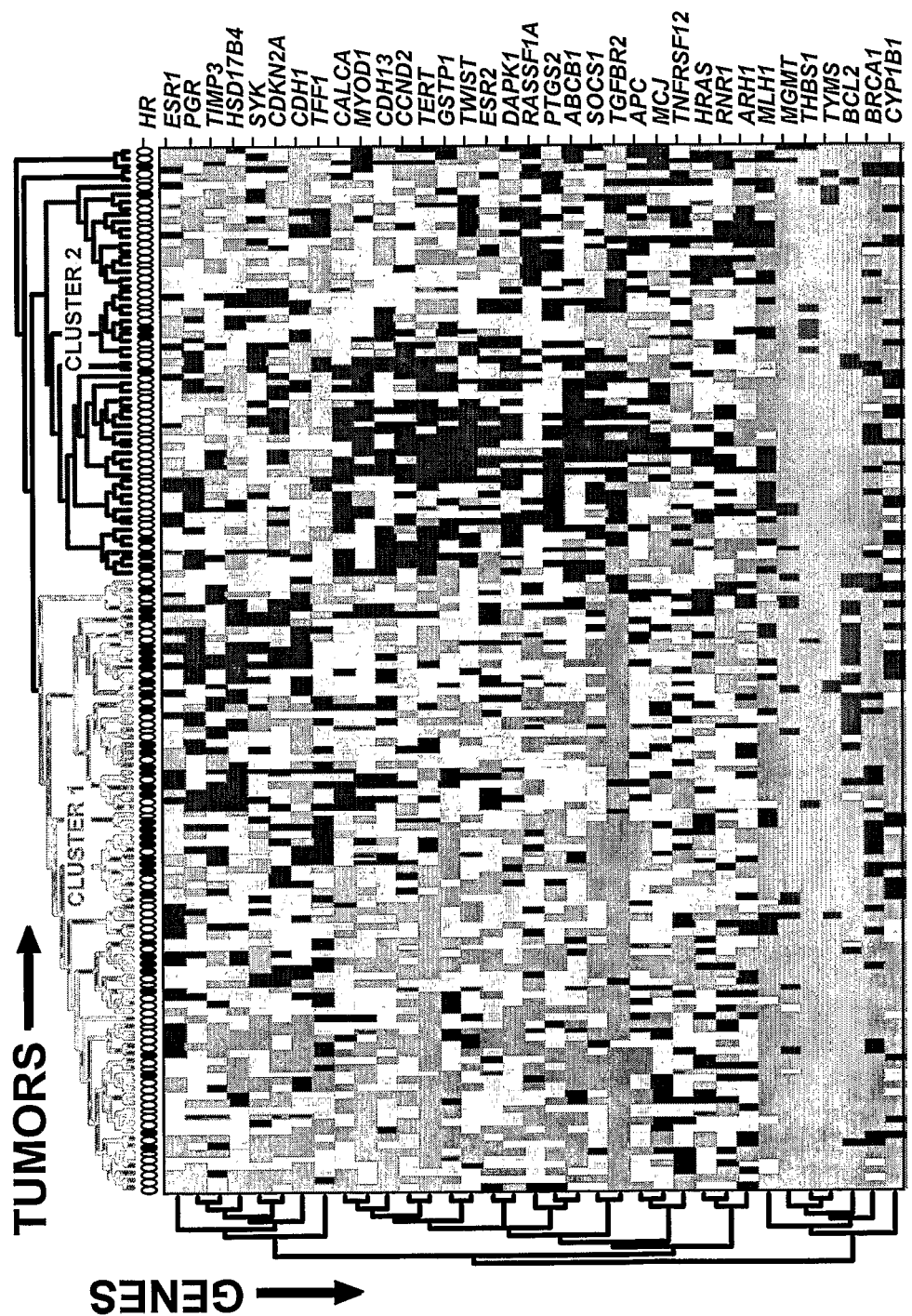
FIG. 1 shows, according to exemplary aspects of the present invention, unsupervised Hierarchical Clustering of DNA Methylation Markers and breast Carcinomas. Agglomerative hierarchical analysis was used to cluster samples (columns) and DNA methylation gene markers (rows) as listed on the right. Quartiles of DNA methylation measures (PMR values) are indicated by color (or grayscale). The analyses revealed two major tumor clusters, based on distinct methylation profiles, that also differed significantly in their hormone receptor (HR) status.

Characterization of a breast cancer in terms of prognosis and/or prediction of treatment outcome enables a physician to make an informed decision as to a therapeutic regimen with appropriate risk and benefit assessment for the patient.

Applicants herein describe and disclose a surprising level of interaction between DNA methylation changes in breast cancer and hormone receptor status, and/or response to hormonal therapy that was not previously appreciated. Because DNA methylation markers rely on DNA as an analyte, as opposed to the more chemically labile RNA molecule, these results provide robust assays for clinical diagnoses, and for predicting response to antiestrogen therapy in the adjuvant setting.

DNA methylation profiles of 148 human breast tumors were generated and analyzed, revealing significant and novel differences in hormone receptor status between clusters of DNA methylation profiles. Specifically, a moderate-throughput, fluorescence-based, semi-automated quantitative technique called MethyLight™ (Eads, et al., *Nucleic Acids Res*, 28 E32, 2000), was used herein to screen a panel of 35 methylation markers in 148 cases of breast cancer. The results reveal a surprising degree of interaction between DNA methylation and hormone receptor biology in breast cancer cells, and provide clinically useful novel DNA methylation predictors of response to hormonal and non-hormonal breast cancer therapy.

According to a particular aspect of the present invention, among the 35 DNA methylation markers analyzed, the best predictor of progesterone receptor (PR) status was methylation of the estrogen receptor (ER) gene (ESR1).

According to an alternate aspect, among the 35 DNA methylation markers, the best predictor of estrogen receptor (ER) status, was methylation of the progesterone receptor gene (PGR).

According to a particular aspect, ESR1, CYP1B1 and ARHI methylation markers serve as independent predictors of clinical response to endocrine therapy (e.g., systemic hormonal therapy with tamoxifen).

According to an additional aspect, ESR1 methylation outperformed hormone receptor status as a predictor of clinical response in patients treated with the antiestrogen tamoxifen According to a further aspect, promoter methylation of the CYP1B1 gene, encoding a tamoxifen and estradiol metabolizing cytochrome P450, predicted survival differentially in tamoxifen-treated (methylation reflective of enhanced survival) and non-treated patients (methylation reflective of decreased survival).

According to another aspect, high levels of promoter methylation of the ARHI gene, encoding a RAS-related small G-protein, were strongly predictive of better survival (diagnostic of better survival) in patients who had not received tamoxifen therapy.

According to preferred aspects of the present invention, ESR1 methylation predicts survival only in tamoxifen treated patients, and ARHI methylation predicts survival only in non-tamoxifen treated patients, while CYP1B1 methylation predicts survival differentially in tamoxifen-treated and non-treated patients.

Without being bound by mechanism, these differences in DNA methylation profiles likely reflect alternative pathways of tumorigenesis associated with differences in hormone receptor status, possibly due to different originating cell types (see e.g. Sorlie, T., et al., *Proc Natl Acad Sci USA*, 100:8418-8423, 2003) and/or disease etiology (see e.g., Potter, et al., *Cancer Epidemiol Biomarkers Prev*, 4:319-326, 1995).

DEFINITIONS

In the context of the present invention the terms "estrogen receptor positive" and/or "progesterone receptor positive" when used to describe a breast cell proliferative disorder are taken to mean that the proliferating cells express said hormone receptor.

The phrase "Cell proliferative disorders of breast tissues" includes, but is not limited to, ductal carcinoma in situ, invasive ductal carcinoma, invasive lobular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

In the context of the present invention the term 'aggressiveness' is taken to mean one or more of: high likelihood of relapse post surgery; below average or below median patient survival; below average or below median disease free survival; below average or below median relapse-free survival; above average tumor-related complications; fast progression of tumor or metastases. According to the aggressiveness of the disease an appropriate treatment or treatments may be selected from the group consisting of chemotherapy, radiotherapy, surgery, biological therapy, immunotherapy, antibody treatments, treatments involving molecularly targeted drugs, estrogen receptor modulator treatments, estrogen receptor down-regulator treatments, aromatase inhibitors treatments, ovarian ablation, treatments providing LHRH analogues or other centrally acting drugs influencing estrogen production. Wherein a cancer is characterized as 'aggressive' it is particularly preferred that a treatment such as, but not limited to, chemotherapy is provided in addition to or instead of an endocrine targeting therapy.

Indicators of tumor aggressiveness standard in the art include but are not limited to, tumor stage, tumor grade, nodal status and survival.

Unless stated otherwise as used herein the term "survival" shall be taken to include all of the following: survival until mortality, also known as overall survival (wherein said mortality may be either irrespective of cause or breast tumor related); "recurrence-free survival" (wherein the term recurrence shall include both localized and distant recurrence); metastasis free survival; disease free survival (wherein the term disease shall include breast cancer and diseases associated therewith). The length of said survival may be calculated by reference to a defined start point (e.g., time of diagnosis or start of treatment) and end point (e.g., death, recurrence or metastasis).

As used herein the term "prognostic marker" shall be taken to mean an indicator of the likelihood of progression of the disease, in particular aggressiveness and metastatic potential of a breast tumor.

As used herein the term 'predictive marker' shall be taken to mean an indicator of response to therapy, said response is preferably defined according to patient survival. It is preferably used to define patients with high, low and intermediate length of survival or recurrence after treatment, that is the result of the inherent heterogeneity of the disease process.

As defined herein the term 'predictive marker' may in some situations fall within the remit of a herein described 'prognostic marker', for example, wherein a prognostic marker differentiates between patients with different survival outcomes pursuant to a treatment, said marker is also a predictive marker for said treatment. Therefore, unless otherwise stated the two terms shall not be taken to be mutually exclusive.

As used herein the term 'expression' shall be taken to mean the transcription and translation of a gene, as well as the genetic or the epigenetic modifications of the genomic DNA associated with the marker gene and/or regulatory or promoter regions thereof. Genetic modifications include SNPs, point mutations, deletions, insertions, repeat length, rearrangements and other polymorphisms. The analysis of either the expression levels of protein, or mRNA or the analysis of the patient's individual genetic or epigenetic modification of the marker gene are herein summarized as the analysis of expression of the gene.

The level of expression of a gene may be determined by the analysis of any factors associated with or indicative of the level of transcription and translation of a gene including but not limited to methylation analysis, loss of heterozygosity (hereinafter also referred to as LOH), RNA expression levels and protein expression levels.

Furthermore the activity of the transcribed gene may be affected by genetic variations such as but not limited to genetic modifications (including but not limited to SNPs, point mutations, deletions, insertions, repeat length, rearrangements and other polymorphisms).

The terms "endocrine therapy" or "endocrine treatment" are meant to comprise any therapy, treatment or treatments targeting the estrogen receptor pathway or estrogen synthesis pathway or estrogen conversion pathway, which is involved in estrogen metabolism, production or secretion. Said treatments include, but are not limited to estrogen receptor modulators, estrogen receptor down-regulators, aromatase inhibitors, ovarian ablation, LHRH analogues and other centrally acting drugs influencing estrogen production.

The term "monotherapy" shall be taken to mean the use of a single drug or other therapy.

In the context of the present invention the term "chemotherapy" is taken to mean the use of pharmaceutical or chemical substances to treat cancer. This definition excludes radiation therapy (treatment with high energy rays or particles), hormone therapy (treatment with hormones or hormone analogues) and surgical treatment.

In the context of the present invention the term "adjuvant treatment" is taken to mean a therapy of a cancer patient immediately following an initial non-chemotherapeutical therapy, (e.g., surgery). In general, the purpose of an adjuvant therapy is to decrease the risk of recurrence.

In the context of the present invention the term "determining a suitable treatment regimen for the subject" is taken to mean the determination of a treatment regimen (i.e., a single therapy or a combination of different therapies that are used for the prevention and/or treatment of the cancer in the patient) for a patient that is started, modified and/or ended based or essentially based or at least partially based on the results of the analysis according to the present invention. One example is starting an adjuvant endocrine therapy after surgery, another would be to modify the dosage of a particular chemotherapy. The determination can, in addition to the results of the analysis according to the present invention, be based on personal characteristics of the subject to be treated. In most cases, the actual determination of the suitable treatment regimen for the subject will be performed by the attending physician or doctor.

In the context of this invention the terms "obtaining a biological sample" or "obtaining a sample from a subject", shall not be taken to include the active retrieval of a sample from an individual, (e.g., the performance of a biopsy). Said terms shall be taken to mean the obtainment of a sample previously isolated from an individual. Said samples may be isolated by any means standard in the art, including but not limited to biopsy, surgical removal, body fluids isolated by means of aspiration. Furthermore said samples may be provided by third parties including but not limited to clinicians, couriers, commercial sample providers and sample collections.

In the context of the present invention, the term "CpG island" refers to a contiguous region of genomic DNA that satisfies the criteria of (1) having a frequency of CpG dinucleotides corresponding to an "Observed/Expected Ratio">0.6, and (2) having a "GC Content">0.5. CpG islands are typically, but not always, between about 0.2 to about 1 kb in length.

In the context of the present invention the term "regulatory region" of a gene is taken to mean nucleotide sequences which affect the expression of a gene. Said regulatory regions may be located within, proximal or distal to said gene. Said regulatory regions include but are not limited to constitutive promoters, tissue-specific promoters, developmental-specific promoters, inducible promoters and the like. Promoter regulatory elements may also include certain enhancer sequence elements that control transcriptional or translational efficiency of the gene.

In the context of the present invention, the term "methylation" refers to the presence or absence of 5-methylcytosine ("5-mCyt") at one or a plurality of CpG dinucleotides within a DNA sequence.

In the context of the present invention the term "methylation state" is taken to mean the degree of methylation present in a nucleic acid of interest, this may be expressed in absolute or relative terms (i.e., as a percentage or other numerical value) or by comparison to another tissue and therein described as hypermethylated, hypomethylated or as having significantly similar or identical methylation status.

In the context of the present invention, the term "hemimethylation" or "hemimethylation" refers to the methylation state of a CpG methylation site, where only a single cytosine in one of the two CpG dinucleotide sequences of the double stranded CpG methylation site is methylated (e.g., 5'-NNC-$^M$GNN-3' (top strand): 3'-NNGCNN-5' (bottom strand)).

In the context of the present invention, the term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample.

In the context of the present invention, the term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

In the context of the present invention, the term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as genetic modifications or mutations are, in particular, insertions, deletions, point mutations, inversions and polymorphisms and, particularly preferred, SNPs (single nucleotide polymorphisms).

"Epigenetic modifications" or "epigenetic parameters" are modifications of DNA bases of genomic DNA and sequences further required for their regulation, in particular, cytosine methylations thereof. Further epigenetic parameters include, for example, the acetylation of histones which, however, cannot be directly analyzed using the described method but which, in turn, correlate with the DNA methylation.

In the context of the present invention, the term "bisulfite reagent" refers to a reagent comprising bisulfite, disulfite, hydrogen sulfite or combinations thereof, useful as disclosed herein to distinguish between methylated and unmethylated CpG dinucleotide sequences.

In the context of the present invention, the term "Methylation assay" refers to any assay for determining the methylation state of one or more CpG dinucleotide sequences within a sequence of DNA.

In the context of the present invention, the term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

In the context of the present invention, the term "MethyLight™" refers to the art-recognized fluorescence-based real-time PCR technique described by Eads et al., *Cancer Res.* 59:2302-2306, 1999.

In the context of the present invention, the term "HeavyMethyl™" assay, in the embodiment thereof implemented herein, refers to a methylation assay comprising methylation specific blocking probes covering CpG positions between the amplification primers.

The term "Ms-SNuPE" (Methylation-sensitive Single Nucleotide Primer Extension) refers to the art-recognized assay described by Gonzalgo & Jones, *Nucleic Acids Res.* 25:2529-2531, 1997.

In the context of the present invention the term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

In the context of the present invention the term "COBRA" (Combined Bisulfite Restriction Analysis) refers to the art-recognized methylation assay described by Xiong & Laird, *Nucleic Acids Res.* 25:2532-2534, 1997.

In the context of the present invention the term "hybridization" is to be understood as a bond of an oligonucleotide to a complementary sequence along the lines of the Watson-Crick base pairings in the sample DNA, forming a duplex structure.

"Stringent hybridization conditions," as defined herein, involve hybridizing at 68° C. in 5×SSC/5×Denhardt's solution/1.0% SDS, and washing in 0.2×SSC/0.1% SDS at room temperature, or involve the art-recognized equivalent thereof (e.g., conditions in which a hybridization is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley & Sons, N.Y.) at Unit 2.10.

"Background DNA" as used herein refers to any nucleic acids which originate from sources other than breast cells.

Overview:

The compositions and novel methods disclosed and described herein provide statistically significant models of patient relapse, disease free survival, metastasis free survival, overall survival and/or disease progression having utility to assist patients and clinicians in determining suitable treatment options to be included in therapeutic regimens.

Particular aspects provide prognostic markers for a cell proliferative disorder of the breast tissues. Preferably, the prognosis is provided in terms of an outcome selected from the group consisting of likelihood of relapse; overall patient survival; metastasis free survival; disease free survival or disease progression.

In further aspects, particular markers are used as predictive markers of outcome of a treatment which targets the estrogen receptor pathway or is involved in estrogen metabolism, production or secretion as a therapy for patients suffering from a cell proliferative disorder of the breast tissues. These aspects enable a physician to determine which treatments may be used in addition to or instead of said endocrine treatment. Preferably, the additional treatment is a more aggressive therapy such as, but not limited to, chemotherapy. Thus, these aspects reduce the problems associated with present breast cell proliferative disorder prognostic, predictive and treatment response prediction methods.

Using the inventive methods, patient survival can be evaluated before or during treatment for a cell proliferative disorder of the breast tissues, to provide critical information to the patient and clinician as to the likely progression of the disease. The methods and nucleic acids exemplified herein have substantial utility to improve a patient's quality of life and odds of treatment success by providing both patient and clinician a with more accurate assessment of the patient's treatment options.

The inventive methods have substantial utility for the improved treatment of all breast cell proliferative disorder patients, both pre- and post-menopausal and independent of their node or estrogen receptor status. In particular embodiments, the patients are node-negative and estrogen receptor positive.

Additional aspects provide a method for the improved treatment of breast cell proliferative disorders, by enabling the improved prediction of a patient's survival; in particular, by predicting the likelihood of relapse post-surgery, both with or without adjuvant endocrine treatment. Further aspects provide means for improved prediction of treatment outcome with endocrine therapy, wherein said therapy comprises one or more treatments which target the estrogen receptor pathway or are involved in estrogen metabolism, production, or secretion.

The inventive methods have substantial utility for the analysis of a wide variety of cell proliferative disorders of the breast tissues including, but not limited to, ductal carcinoma in situ, invasive ductal carcinoma, invasive lobular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

The inventive methods have utility to provide a prognosis of breast cell proliferative disorder patients, and/or to provide a prediction of patient survival and/or relapse following treatment by endocrine therapy.

Where the particular disclosed markers, methods and nucleic acids are used as prognostic markers, the prognosis is preferably defined in terms of patient survival and/or relapse. In such embodiments, patients survival times and/or relapse are predicted according to their gene epigenetic modifications (e.g., methylation status) (and in some instances, respective gene expression). In particular embodiments, the patients are tested prior to receiving any adjuvant endocrine treatment.

Where the particular disclosed markers, methods and nucleic acids are used as predictive markers, the prediction is preferably applied to the outcome of patients who receive endocrine treatment as secondary treatment to an initial non chemotherapeutical therapy, for example, surgery (e.g., the 'adjuvant setting'). Such a treatment is typically prescribed to patients suffering from stage 1 to 3 breast carcinomas. Preferably, 'outcome' is defined in terms of patients survival and/or relapse.

Preferably, in such embodiments, patients survival times and/or relapse are predicted according to their epigenetic modifications (e.g., methylation status). By detecting patients with below average or below median metastasis free survival or disease free survival times and/or high likelihood of relapse, the physician may choose to recommend the patient for further treatment, instead of or in addition to the endocrine targeting therapy(s), in particular but not limited to, chemotherapy.

Aspects of inventive methods provide, inter alia, novel breast cell proliferative disorder prognostic and predictive biomarkers and methods for using same.

Antiestrogen Therapies Encompassed by the Present Invention

Antiestrogens: Partial Agonists and Antagonists. According to preferred aspects of the present invention, methylation markers can be used to effectively predict receptor status, and further to predict responsiveness to antiestrogen therapy. Because antiestrogens primarily function through their ability to compete with available estrogens for binding to ER (Clarke et al. (Clarke et al., Phamacological Reviews, 53:25-72, 2001; Cellular and Molecular Pharmacology of Antiestrogen Action and Resistance), the present invention encompasses, in addition to tamoxifen (TAM), other antiestrogens that act through ER, as well as antiestrogens that belongs to the new group of selective estrogen receptor destabilisators (SERD).

Several triphenylethelene variations on TAM are available, including Toremifene (chloro-TAM) and Droloxifene (3-OH-TAM). Both drugs seem to be approximately equivalent to TAM in terms of their antitumor activities and toxicities; both drugs are partial agonists. The clinical utility of several of these newer antiestrogens has recently been reviewed (Lien & Lonning, Cancer Treat Rev, 26:205-227, 2000).

Other encompassed antiestrogens are the steroidal compounds ICI 164,384 (N-(n-butyl)-11-[3,17 beta-dihydroxy-estra-1,3,5(10)-trien-7 alpha-yl]N-methylundecanamide) and ICI 182,780 (trade name: Faslodex). Both ICI 164,384 and ICI 182,780 have high affinities for ER. Both ICI 164,384 and ICI 182,780 appear to be antagonists, being devoid of agonist activity in most experimental models. Moreover, ICI 164,384 can inhibit the agonist effects of both estrogen and TAM.

Additionally encompassed antiestrogens are not triphenylethylenes, including the non-triphenylethylene Raloxifene (a benzothiophene; previously called keoxifene; LY 156,758).

Additionally, ZK 191703 belongs to a new group of selective estrogen receptor destabilisators (SERD), and is a highly active pure antiestrogen with high receptor specificity (in transactivation assays utilizing ER-driven reporter gene systems, ZK 191703 shows an antiestrogenic potency with an $IC_{50}$ of 2 nM).

Therefore, according to the present invention, DNA methylation markers can be used to predict responsiveness to a variety of antiestrogens, where the most important biological consequence is whether the activated receptor complex induces an estrogenic or antiestrogenic response.

Methylation Assay Procedures

Various methylation assay procedures are known in the art, and can be used in conjunction with the present invention. These assays allow for determination of the methylation state of one or a plurality of CpG dinucleotides within a DNA sequence (e.g., CpG islands). Such assays involve, among other techniques, DNA sequencing of bisulfite-treated DNA, PCR (for sequence-specific amplification), Southern blot analysis, use of methylation-sensitive restriction enzymes, etc.

For example, genomic sequencing has been simplified for analysis of DNA methylation patterns and 5-methylcytosine distribution by using bisulfite treatment (Frommer et al., Proc. Natl. Acad. Sci. USA 89:1827-1831, 1992). Additionally, restriction enzyme digestion of PCR products amplified from bisulfite-converted DNA is used, e.g., the method described by Sadri & Hornsby (Nucl. Acids Res. 24:5058-5059, 1996), or COBRA (Combined Bisulfite Restriction Analysis) (Xiong & Laird, Nucleic Acids Res. 25:2532-2534, 1997).

Preferably, assays such as "MethyLight™" (a fluorescence-based real-time PCR technique) (Eads et al., Cancer Res. 59:2302-2306, 1999), Methylation-sensitive Single Nucleotide Primer Extension reactions ("Ms-SnuPE"; Gonzalgo & Jones, Nucleic Acids Res. 25:2529-2531, 1997), methylation-specific PCR ("MSP"; Herman et al., Proc. Natl. Acad. Sci. USA 93:9821-9826, 1996; U.S. Pat. No. 5,786,146), and methylated CpG island amplification ("MCA"; Toyota et al., Cancer Res. 59:2307-12, 1999) are used alone or in combination with other of these methods. Methylation assays that can be used in various embodiments of the present invention include, but are not limited to, the following assays.

COBRA (Combined Bisulfite Restriction Analysis). COBRA analysis is a quantitative methylation assay useful for determining DNA methylation levels at specific gene loci in small amounts of genomic DNA (Xiong & Laird, Nucleic Acids Res. 25:2532-2534, 1997). Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (Proc. Natl. Acad. Sci. USA 89:1827-1831, 1992). PCR amplification of the bisulfite converted DNA is then performed using primers specific for the interested CpG islands, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. Additionally, this technique can be reliably applied to DNA obtained from microdissected paraffin-embedded tissue samples. Typical reagents (e.g., as might be found in a typical COBRA-based methylation kit) for COBRA analysis may include, but are not limited to: PCR primers for specific gene (or methylation-altered DNA sequence or CpG island); restriction enzyme and appropriate buffer; gene-hybridization oligo; control hybridization oligo; kinase labeling kit for oligo probe; and radioactive nucleotides (although other label schemes known in the art including, but not limited, to fluorescent and phosphorescent schemes can be used). Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

Ms-SnuPE (Methylation-sensitive Single Nucleotide Primer Extension). The Ms-SNuPE technique is a quantitative method for assessing methylation differences at specific CpG sites based on bisulfite treatment of DNA, followed by single-nucleotide primer extension (Gonzalgo & Jones, *Nucleic Acids Res.* 25:2529-2531, 1997). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. Small amounts of DNA can be analyzed (e.g., microdissected pathology sections), and it avoids utilization of restriction enzymes for determining the methylation status at CpG sites. Typical reagents (e.g., as might be found in a typical Ms-SNuPE-based methylation kit) for Ms-SNuPE analysis may include, but are not limited to: PCR primers for specific gene (or methylation-altered DNA sequence or CpG island); optimized PCR buffers and deoxynucleotides; gel extraction kit; positive control primers; Ms-SNuPE primers for specific gene; reaction buffer (for the Ms-SNuPE reaction); and radioactive nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

MSP (Methylation-specific PCR). MSP allows for assessing the methylation status of virtually any group of CpG sites within a CpG island, independent of the use of methylation-sensitive restriction enzymes (Herman et al. *Proc. Natl. Acad. Sci. USA* 93:9821-9826, 1996; U.S. Pat. No. 5,786,146). Briefly, DNA is modified by sodium bisulfite converting all unmethylated, but not methylated cytosines to uracil, and subsequently amplified with primers specific for methylated versus unmethylated DNA. MSP requires only small quantities of DNA, is sensitive to 0.1% methylated alleles of a given CpG island locus, and can be performed on DNA extracted from paraffin-embedded samples. Typical reagents (e.g., as might be found in a typical MSP-based kit) for MSP analysis may include, but are not limited to: methylated and unmethylated PCR primers for specific gene (or methylation-altered DNA sequence or CpG island), optimized PCR buffers and deoxynucleotides, and specific probes.

MCA (Methylated CpG Island Amplification). The MCA technique is a method that can be used to screen for altered methylation patterns in genomic DNA, and to isolate specific sequences associated with these changes (Toyota et al., *Cancer Res.* 59:2307-12, 1999). Briefly, restriction enzymes with different sensitivities to cytosine methylation in their recognition sites are used to digest genomic DNAs from primary tumors, cell lines, and normal tissues prior to arbitrarily primed PCR amplification. Fragments that show differential methylation are cloned and sequenced after resolving the PCR products on high-resolution polyacrylamide gels. The cloned fragments are then used as probes for Southern analysis to confirm differential methylation of these regions. Typical reagents (e.g., as might be found in a typical MCA-based kit) for MCA analysis may include, but are not limited to: PCR primers for arbitrary priming Genomic DNA; PCR buffers and nucleotides, restriction enzymes and appropriate buffers; gene-hybridization oligos or probes; control hybridization oligos or probes.

DAMH (Diffferential Methylation Hybridization). DMH refers to the art-recognized, array-based methylation assay described in Huang et al., *Hum. Mol. Genet.,* 8:459-470, 1999, and in Yan et al., *Clin. Cancer Res.* 6:1432-38, 2000. DMH allows for a genome-wide screening of CpG island hypermethylation in cancer cell lines, and. Briefly, CpG island tags are arrayed on solid supports (e.g., nylon membranes, silicon, etc.), and probed with "amplicons" representing a pool of methylated CpG DNA, from test (e.g., tumor) or reference samples. The differences in test and reference signal intensities on screened CpG island arrays reflect methylation alterations of corresponding sequences in the test DNA.

MethyLight™. In preferred embodiments, the MethyLight™ assay is used to determine the methylation status of one or more CpG sequences. The MethyLight™ assay is a high-throughput quantitative methylation assay that utilizes fluorescence-based real-time PCR (TaqMan™) technology that requires no further manipulations after the PCR step (Eads et al., *Cancer Res.* 60:5021-5026, 2000; Eads et al., *Cancer Res.* 59:2302-2306, 1999; Eads et al., *Nucleic Acids Res.* 28:E32, 2000). Briefly, the MethyLight™ process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed either in an "unbiased" (with primers that do not overlap known CpG methylation sites) PCR reaction, or in a "biased" (with PCR primers that overlap known CpG dinucleotides) reaction. Sequence discrimination can occur either at the level of the amplification process or at the level of the fluorescence detection process, or both.

The MethyLight™ assay may assay be used as a quantitative test for methylation patterns in the genomic DNA sample, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the "MSP" technique), or with oligonucleotides covering potential methylation sites.

The "HeavyMethyl™" assay is a variation of the MethyLight™ assay, comprising methylation specific blocking probes covering CpG positions between the amplification primers.

EXEMPLARY SPECIFIC EMBODIMENTS

Methods for predicting response to endocrine therapy. Particular aspects of the present invention provide a method for predicting response to endocrine treatment of a cell proliferative disorder of the breast tissue, comprising: isolating genomic DNA from a breast tissue sample obtained from a subject having a breast cell proliferative disorder; treating the genomic DNA, or a portion thereof, with one or more reagents suitable to distinguish between cytosine and 5-methylcytosine bases; and determining, based on the treating, a methylation state of at least one CpG dinucleotide of at least one gene sequence selected from the group consisting CYP1B1, ESR1, contiguous portions thereof, and sequences complementary thereto, wherein predicting a response to endocrine treatment of the cell proliferative disorder based on the determined methylation state is, at least in part, afforded.

In particular embodiments, the at least one CpG dinucleotide is of at least one sequence selected from the group consisting of SEQ ID NOS:9, 13, contiguous portions thereof, and sequences complementary thereto.

In particular embodiments, the determined methylation state is that of at least one CpG dinucleotide of CYP1B1, contiguous portions thereof, and sequences complementary thereto, and wherein a favorable diagnosis is positively correlated with the extent of CpG methylation. Preferably, the at least one CpG dinucleotide is of SEQ ID NOS:9, contiguous portions thereof, and sequences complementary thereto.

In additional embodiments, the determined methylation state is that of at least one CpG dinucleotide of ESR1, contiguous portions thereof, and sequences complementary thereto, and wherein a favorable diagnosis is positively correlated with the extent of CpG methylation. Preferably, the at least one CpG dinucleotide is of SEQ ID NOS: 13, contiguous portions thereof, and sequences complementary thereto.

Methods for prognosis of a cell proliferative disorder of the breast tissue. Additional aspects of the present invention provide a method for prognosis of a cell proliferative disorder of the breast tissue, comprising: isolating genomic DNA from a breast tissue sample obtained from a subject having a breast cell proliferative disorder; treating the genomic DNA, or a portion thereof, with one or more reagents suitable to distinguish between cytosine and 5-methylcytosine bases; and determining, based on the treating, a methylation state of at least one CpG dinucleotide of at least one gene sequence selected from the group consisting of ARHI, CYP1B1, ESR1, contiguous portions thereof, and sequences complementary thereto, wherein prognosis of the cell proliferative disorder of the breast tissue based on the determined methylation state is, at least in part, afforded.

In particular embodiments, the at least one CpG dinucleotide is of at least one sequence selected from the group consisting of SEQ ID NOS:1, 9, 13, contiguous portions thereof, and sequences complementary thereto. In certain embodiments, the determined methylation state is that of at least one CpG dinucleotide of ARHI, contiguous portions thereof, and sequences complementary thereto, the subject is not endocrine treated, and a favorable prognosis is positively correlated with the extent of CpG methylation. Preferably, the at least one CpG dinucleotide is of SEQ ID NOS: 1, contiguous portions thereof, and sequences complementary thereto.

In alternate embodiments, the determined methylation state is that of at least one CpG dinucleotide of CYP1B1, contiguous portions thereof, and sequences complementary thereto, the subject is not endocrine treated, and a favorable prognosis is negatively correlated with the extent of CpG methylation. Preferably, the at least one CpG dinucleotide is of SEQ ID NOS:9, contiguous portions thereof, and sequences complementary thereto.

In additional embodiments, the determined methylation state is that of at least one CpG dinucleotide of CYP1B1, contiguous portions thereof, and sequences complementary thereto, the subject is endocrine treated, and a favorable prognosis is positively correlated with the extent of CpG methylation. Preferably, the at least one CpG dinucleotide is of SEQ ID NOS:9, contiguous portions thereof, and sequences complementary thereto.

In further embodiments, the determined methylation state is that of at least one CpG dinucleotide of ESR1, contiguous portions thereof, and sequences complementary thereto, the subject is endocrine treated, and a favorable prognosis is positively correlated with the extent of CpG methylation. Preferably, the at least one CpG dinucleotide is of SEQ ID NOS:13, contiguous portions thereof, and sequences complementary thereto.

Methods for determining hormone receptor status of breast tissue. Further aspects of the present invention provide a method for determining hormone receptor (HR) status of breast tissue, comprising: isolating genomic DNA from a breast tissue sample obtained from a subject having a breast cell proliferative disorder; treating the genomic DNA, or a fragment or portion thereof, with one or more reagents suitable to distinguish between cytosine and 5-methylcytosine bases; determining, based on the treating, a methylation state of at least one CpG dinucleotide of at least one gene sequence selected from the group consisting of BCL2, PGR, RASSF1A, SOCS1, GSTP1, PTGS2, TGFBR2, contiguous portions thereof, and sequences complementary thereto; and further determining, based on the methylation state, a positive or negative hormone receptor status, wherein a positive hormone receptor status corresponds to a presence of estrogen receptor (ER), progesterone receptor (PR) or both, and is determined based on: a positive correlation with CpG methylation within RASSF1A, SOCS1, GSTP1, PTGS2, TGFBR2, contiguous portions thereof, and sequences complementary thereto; a negative correlation of CpG methylation within BCL2, PGR, contiguous portions thereof, and sequences complementary thereto; or both.

In particular embodiments, the RASSF1A, SOCS1, GSTP1, PTGS2 and TGFBR2 sequences are SEQ ID NOS: 21, 25, 41, 53 and 61, respectively, and the BCL2 and PGR sequences are SEQ ID NOS:5 and 17, respectively.

In additional embodiments, determining a methylation state is of the methylation state of at least one CpG dinucleotide of SOCS1, contiguous portions thereof, and sequences complementary thereto, and a positive hormone receptor status is determined based on a positive correlation with CpG methylation. Preferably, the at least one CpG dinucleotide is of SEQ ID NOS:25, contiguous portions thereof, and sequences complementary thereto.

Methods for determining estrogen receptor (ER) status of breast tissue. Yet further aspects of the present invention provide a method for determining estrogen receptor (ER) status of breast tissue, comprising: isolating genomic DNA from a breast tissue sample obtained from a subject having a breast cell proliferative disorder; treating the genomic DNA, or a fragment or portion thereof, with one or more reagents suitable to distinguish between cytosine and 5-methylcytosine bases; determining, based on the treating, a methylation state of at least one CpG dinucleotide of at least one gene sequence selected from the group consisting of PGR, contiguous portions thereof, and sequences complementary thereto; and further determining, based on the methylation state, a positive or negative estrogen receptor (ER) status, wherein a positive ER status is determined based on a negative correlation of CpG methylation within PGR, contiguous portions thereof, and sequences complementary thereto. Preferably, the PGR sequence is SEQ ID NO: 17.

Methods for determining progesterone receptor (PR) status of breast tissue. Additional aspects of the present invention provide a method for determining progesterone receptor (PR) status of breast tissue, comprising: isolating genomic DNA from a breast tissue sample obtained from a subject having a breast cell proliferative disorder; treating the genomic DNA, or a fragment or portion thereof, with one or more reagents suitable to distinguish between cytosine and 5-methylcytosine bases; determining, based on the treating, a methylation state of at least one CpG dinucleotide of at least one gene sequence selected from the group consisting of ESR1, contiguous portions thereof, and sequences complementary thereto; and further determining, based on the methylation state, a positive or negative estrogen receptor (ER) status, wherein a positive ER status is determined based on a positive correlation of CpG methylation within ESR1, contiguous portions thereof, and sequences complementary thereto. Preferably, the ESR1 sequence is SEQ ID NO: 13.

Exemplary endocrine treatments, breast cell proliferative disorders, agents for distinguishing between cytosine and 5-methylcytosine bases, and methylation assays. In particular embodiments of the above methods and aspects, the response to endocrine treatment comprises response to treatment with at least one agent selected from the group consisting of tamoxifen, selective estrogen receptor modulators (SERM), estrogen receptor down-regulators, aromatase inhibitors, LHRH analogues, toremifene (chloro-TAM) and droloxifene (3-OH-TAM), ICI 164,384 (N-(n-butyl)-11-[3,17 beta-dihydroxy-estra-1,3,5(10)-trien-7 alpha-yl]N-methylundecanamide) and ICI 182,780 (7alpha-(9-((4,4,5,5,5-Pentafluoropentyl)sulfinyl)nonyl)estra-1,3,5(10)-triene-3,17beta-diol) (Faslodex), (2-(4-Hydroxyphenyl)-6-hydroxybenzo(b)thien-3-yl)(4-(2-(1-piperidinyl)ethoxy)phenyl)methanone (Raloxifene), selective estrogen receptor destabilisators (SERD), and ovarian ablation.

Additionally, in particular embodiments of the above methods and aspects, the breast cell proliferative disorder is at least one selected from the group consisting of ductal carcinoma in situ, invasive ductal carcinoma, invasive lobular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

Furthermore, in particular embodiments of the above methods and aspects, the one or more reagents suitable to distinguish between cytosine and 5-methylcytosine bases comprises a solution selected from the group consisting of bisulfite, hydrogen sulfite, disulfite, and combinations thereof.

Additionally, in particular embodiments of the above methods and aspects, determining a methylation state comprises use of at least one method taken from the group consisting of oligonucleotide hybridization analysis, Ms-SnuPE, sequencing, Real-Time detection probes, and oligonucleotide array analysis.

Example 1

Materials and Methods Used

Tissues. Tumor samples were retrieved from the tissue bank of the Department of Obstetrics and Gynecology, Innsbruck University Hospital (Innsbruck, Austria). Clinical, pathological and follow-up data are stored in a database in accordance with hospital privacy rules. Specimens were brought to the pathologist (E.M.-H.) immediately after resection, and part of the tissue was placed in liquid nitrogen and stored at −80° C. until lyophilization. A total of 148 patients with breast cancer treated at the Department of Obstetrics and Gynecology, University of Innsbruck, between 1989 and 2000, were included in this study. Patient characteristics are provided separately in TABLE 1 (Data Supplement 1).

Histopathological Analyses. All breast cancer specimens were reviewed by a single pathologist (E.M.-H.). HR positivity was defined as presence of ER and/or PR in >10% of tumor cells (immunohistochemistry was done for the 106 breast cancers) or $\geq$15 fmol/mg protein (biochemical assays were performed for 42 breast cancer specimens, which were obtained before immunohistochemistry had been established in applicants' laboratory).

DNA Methylation Analyses. Genomic DNA was isolated using a QIAmp™ tissue kit (Qiagen, Hilden, Germany). Sodium bisulfite conversion of genomic DNA was performed as described previously (Eads, et al., *Nucleic Acids Res*, 28 E32, 2000). DNA methylation analysis was performed by MethyLight™ (Eads, et al., *Nucleic Acids Res*, 28 E32, 2000, Eads, et al., *Cancer Res*, 59:2302-2306, 1999; both incorporated by reference herein in their entirety). Three sets of primers and probes, designed specifically for bisulfite-converted DNA, were used: a methylated set for the gene of interest; and two reference sets, beta-actin (ACTB) and Collagen 2A1 (COL2A1) to normalize for input DNA. The specificity of the reactions for methylated DNA was confirmed separately using SssI (New England Biolabs)-treated human peripheral blood lymphocyte DNA (Promega), which results in near complete methylation of this reference DNA (Eads, et al., *Nucleic Acids Res*, 28 E32, 2000). The percentage of fully methylated molecules at a specific locus was calculated by dividing the GENE:ACTB ratio of a sample by the GENE:ACTB ratio of SssI-treated sperm DNA and multiplying by 100, and separately by dividing the GENE:COL2A1 ratio of a sample by the GENE:COL2A1 ratio of SssI-treated sperm DNA and multiplying by 100. The mean of these two resulting values was used in subsequent statistical analyses. The abbreviation PMR (Percentage of fully Methylated Reference) is used to indicate this measurement (Eads, et al., *Cancer Res*, 61:3410-3418, 2001, incorporated by reference herein in its entirety).

For EXAMPLE 2 below, the initial 64 methylation markers and the final panel of 35 markers were selected based on likelihood of a role for DNA methylation in breast cancer or likelihood of involvement in hormone receptor (H)R action. Primer and probe sequences are shown below in TABLE 2 (Data Supplement 2).

MethyLight™ technology was selected for the present study, rather than MSP™ or the methylation microarray technologies currently under development. One of the unique features of MethyLight™ technology is that the resulting data are comprised of a mixture of discrete and variable measures. The discrete measures arise from the large number of data points with undetectable methylation (PMR values of zero), versus the data points with positive detection of methylation. This type of data structure is similar to that obtained with MSP™ analysis. On the other hand, the quantitative nature of MethyLight™ also generates continuous measures for the samples with detectable levels of DNA methylation. Applicants show herein that useful information can be extracted from both types of measures. For example, as shown in EXAMPLE 5 below, among the methylation markers predictive of response to tamoxifen therapy, CYP1B1 was used as a discrete measure of positive versus negative DNA methylation, similar to MSP™ analysis. However, an MSP-based approach for the other two markers predictive of treatment response would have been non-informative, since ESR1 and ARHI are positive in 100% and 99.3% of the samples, respectively (see TABLE 4 (Data Supplement 4)). The quantitative aspect of MethyLight™ analysis was required to reveal the association of these methylation markers with response to tamoxifen therapy.

Expression Analyses. RNA isolation and expression analyses were performed as described (Eads, et al., *Cancer Res*, 59:2302-2306, 1999). Before cDNA synthesis, RNA samples were treated with DNAse to ensure removal of contaminating genomic DNA. TATA box-binding protein (TBP) served as the reference gene. Primer and probe sequences are shown in TABLE 3 (Data Supplement 3).

Statistics. Agglomerative hierarchical cluster analysis in SPLUS 2000™ (Insightful Corp.) was used to cluster samples and DNA methylation markers. Because many of the CpG regions had undetectable methylation, the PMR values were categorized into quartiles (coded 1-4). If more than 25% but fewer than 50% of the samples had undetectable methylation, this resulted in scores of 1 (=undetectable methylation), 2 (detectable methylation and $\leq 50^{th}$ percentile), 3 ($51^{st}$-$75^{th}$ percentile), 4 ($>75^{st}$ percentile). If more than 50% but fewer than 75% of the samples had undetectable methylation, the scores were 1, 3, 4. If more than 75% of the samples had undetectable methylation, the score was either 1 for undetectable methylation or 4 for detectable methylation. Manhattan distance, the sum of the absolute deviations across methylation markers was used to measure dissimilarity. The dissimilarity between clusters was measured by the group average method (Kaufman & Rousseeuw, Wiley Interscience, 1990).

The association between (categorized) PMR values and hormone receptor status was tested using logistic regression. Separate analyses were conducted for each gene.

In preferred applications of the present invention, associations between methylation and hormone receptor status (see TABLE 5, under EXAMPLE 3 herein) were optionally determined in an particularly stringent manner, after adjustment for multiple comparisons. Where, for example, many (e.g., 35) different markers are tested simultaneously, adjustment for the multiple comparisons can optionally be done by controlling the false-discovery rate, which is the expected proportion of false-positive tests among all positive tests (see, e.g., Siegmund and Laird, *Methods*, 27:170-178, 2002, citing Benjamini et al., *Brain Res.* 125:279-284, 2001; and see Thomas & Clayton, Editorial, *J. Nat. Cancer Inst.*, 96:421-423, 2004, citing Benjamini & Hochberg, J. Roy Stat Soc Ser B, 57:289-300, 1995; all of which are incorporated by reference herein).

Multiple linear regression was used to study the relationship between DNA methylation and ESR1 gene expression. A total of 75 samples had ESR1 gene expression measured but one was omitted from the analyses as an outlier (ESR1 upstream A expression >3 SD above the mean). Comparisons between groups of samples and between different genes were simplified by 'expressing' all expression data relative to the mean for the entire set of 74 samples.

Cox regression was used to study the association between PMR values and overall (and disease-free) survival, treating PMR quartiles as ordered categorical variables.

An interaction model was used to test whether the association of PMR values and survival varied by treatment with tamoxifen therapy (received TAM vs. did not receive TAM; Tamoxifen treatment is 20 mg daily for 5 years or until recurrence of disease). The analyses were adjusted for nodal status (0, 1-3, >3) and tumor stage (I, II, III/IV). Nodal status was coded using indicator variables for two of the three levels. All analyses were age adjusted.

TABLE 1

Data Supplement 1; Patient Characteristics

| | | All patients n = 148 | Tamoxifen therapy NO (n = 57) | Tamoxifen therapy YES (n = 91) | P-value for difference |
|---|---|---|---|---|---|
| Age at diagnosis | Mean (in years) | 59.3 | 57.4 | 60.5 | 0.19[a] |
| Menopause | Premenopausal | 46 | 22 | 24 | |
| | Postmenopausal | 102 | 35 | 67 | 0.14[b] |
| Histology | Inv. Ductal | 115 | 44 | 71 | |
| | Others | 33 | 13 | 20 | 1.00[b] |
| Stage (pTNM) | I | 41 | 20 | 21 | |
| | II | 84 | 29 | 55 | |
| | III/IV | 23 | 8 | 15 | 0.18[c] |
| Grade* | I | 44 | 13 | 31 | |
| | II | 78 | 30 | 48 | |
| | III | 22 | 12 | 10 | 0.055[c] |
| Axill. Lymphnodes pos.* | 0 | 46 | 21 | 25 | |
| | 1-3 | 35 | 7 | 28 | |
| | >3 | 58 | 24 | 34 | 0.76[c] |
| HR-status | Neg (ER/PR neg) | 41 | 29 | 12 | |
| | Pos (ER +/− PR pos) | 107 | 28 | 79 | <0.001[b] |
| HER2 status* | Neg | 102 | 40 | 62 | |
| | Pos | 41 | 13 | 28 | 0.45[b] |
| Surgery | Breast conserving | 60 | 27 | 33 | |
| | Mastectomy | 88 | 30 | 58 | 0.23[b] |
| Radiotherapy | No | 54 | 22 | 32 | |
| | Yes | 94 | 35 | 59 | 0.73[b] |
| Chemotherapy | No | 68 | 26 | 42 | |
| | Yes | 80 | 31 | 49 | 1.00[b] |

*grade: 4 unknown; axill. lymphnode status: 9 unknown; HER2 status: 5 unknown.
[a] p for t-Test;
[b] p for Fisher's exact test;
[c] p for Chi-square trend test; all P-values are for two-sided tests.//

TABLE 2

Data Supplement 2; MethyLight™ Primer and Probe Sequences

| HUGO Gene Nomenclature | GenBank Accession Number (SEQ ID NO) | Amplicon Location (GenBank Numbering) (SEQ ID NO) | Forward Primer Sequence (SEQ ID NO) | Reverse Primer Sequence (SEQ ID NO) |
|---|---|---|---|---|
| ABCB1 | L07624 (SEQ ID NO: 77) | 929 bp-1007 bp (SEQ ID NO: 171) | TCGGGTCGGGAGTAGTTATTTG (SEQ ID NO: 78) | CGACTATACTCAACCCACGCC (SEQ ID NO: 79) |
| APC | U02509 (SEQ ID NO: 29) | 759 bp-832 bp | GAACCAAAACGCTCCCCAT (SEQ ID NO: 30) | TTATATGTCGGTTACGTGCGTTTATAT (SEQ ID NO: 31) |
| ARHI | AF202543 (SEQ ID NO: 1) | 1953 bp-2038 bp (SEQ ID NO: 172) | GCGTAAGCGGAATTTATGTTTGT (SEQ ID NO: 2) | CCGGCGATTTTATATTCCGACTT (SEQ ID NO: 3) |
| BCL2 | M14745 (SEQ ID NO: 5) | 215 bp-298 (SEQ ID NO: 173) | TCGTATTTCGGGATTCGGTC (SEQ ID NO: 6) | AACTAAACGCAAACCCCGC (SEQ ID NO: 7) |
| BRCA1 | L78833 (SEQ ID NO: 81) | 3272 bp-3360 bp | GAGAGGTTGTTGTTTTAGCGGTAGTT (SEQ ID NO: 82) | CGCGCAATCGCAATTTTAAT (SEQ ID NO: 83) |
| CALCA | X15943 (SEQ ID NO: 85) | 1706 bp-1806 bp | GTTTTGGAAGTATGAGGGTGACG (SEQ ID NO: 86) | TTCCCGCCCTATAAATCG (SEQ ID NO: 87) |
| CCND2 | U47284 (SEQ ID NO: 89) | 281 bp-344 bp | GGAGGGTCGGCGAGGAT (SEQ ID NO: 90) | TCCTTTCCCGAAAACATAAAA (SEQ ID NO: 91) |
| CDH1 | L34545 (SEQ ID NO: 93) | 842 bp-911 bp | AATTTTAGTTAGAGGGTTATCGCGT (SEQ ID NO: 94) | TCCCAAAACGAAAACTAACGAC (SEQ ID NO: 95) |
| CDH13 | AB001090 (SEQ ID NO: 33) | 1680 bp-1782 bp (SEQ ID NO: 174) | AATTTCGTTCGTTTTGTGCGT (SEQ ID NO: 34) | CTACCCGTACCGACGATCC (SEQ ID NO: 35) |
| CDKN2A | NM_000077 (SEQ ID NO: 97) | 66-133 bp | TGGAGTTTTCGGTTGATTGGTT (SEQ ID NO: 98) | AACAACGCCCGCACCTCCT (SEQ ID NO: 99) |
| CYP1B1 | U56438 (SEQ ID NO: 9) | 2905 bp-2990 bp (SEQ ID NO: 175) | GTGCGTTTGGACGGGAGTT (SEQ ID NO: 10) | AACGGACCTAACAAAACGAA (SEQ ID NO: 11) |
| DAPK1 | X76104 (SEQ ID NO: 101) | 137 bp-204 bp | TCGTCGTCGTTTCCGTTAGTT (SEQ ID NO: 102) | TCCCTCCGAAACGCTATCG (SEQ ID NO: 103) |
| ESR1 | X62462 (SEQ ID NO: 13) | 2784 bp-2884 bp (SEQ ID NO: 176) | GGCGTTCGTTTTGGGATTG (SEQ ID NO: 14) | GCCGACACCGCGAACTCTAA, (SEQ ID NO: 15) |
| ESR2 | AF051427 (SEQ ID NO: 37) | 91 bp-162 bp | TTTGAAATTTGTAGGGCGAAGAGTAG (SEQ ID NO: 38) | ACCCGTCGCAACTCGAATAA (SEQ ID NO: 39) |
| GSTP1 | M24485 (SEQ ID NO: 41) | 1146 bp-1245 bp (SEQ ID NO: 177) | GTCGGCGTCGTGATTTAGTATTG (SEQ ID NO: 42) | AAACTACGACGACGAAACTCCAA (SEQ ID NO: 43) |

TABLE 2-continued

Data Supplement 2; MethyLight™ Primer and Probe Sequences

| | | | |
|---|---|---|---|
| HRAS1 | J00277 (SEQ ID NO: 105) | 1659 bp-1754 bp | GAGGCATGACGGAATAAGTTGG (SEQ ID NO: 106) | CGTCCACAAATAATTCTAAATCAACTAA (SEQ ID NO: 107) |
| HSD17B4 | AF057720 (SEQ ID NO: 45) | 1581 bp-1651 bp | TATCGTTGAGGTTCGACGGG (SEQ ID NO: 46) | TCCAACCTTCGCATACTCACC (SEQ ID NO: 47) |
| MCJ | AF126743 (SEQ ID NO: 109) | 407 bp-487 bp | TTTCGGGTCGTTTTGTTATGG (SEQ ID NO: 110) | ACTACAAATACTCAACGTAACGCAAACT (SEQ ID NO: 111) |
| MGMT | X61657 (SEQ ID NO: 113) | 1067 bp-1149 bp | GCGTTTCGACGTTCGTAGGT (SEQ ID NO: 114) | CACTCTTCCGAAAACGAAACG (SEQ ID NO: 115) |
| MLH1 | U26559 (SEQ ID NO: 49) | 254 bp-341 bp | CGTTATATATCGTTCGTAGTATTCGTGTTT (SEQ ID NO: 50) | CTATCGCCGCCTCATCGT (SEQ ID NO: 51) |
| MYOD1 | AF027148 (SEQ ID NO: 117) | 9889 bp-9962 bp | GAGGCGCGCGTAGTTAGCG (SEQ ID NO: 118) | TCCGACACGCCCTTTCC (SEQ ID NO: 119) |
| PGR | X51730 (SEQ ID NO: 17) | 811 bp-904 bp | TTATAATTCGAGGCGGTTAGTGTTT (SEQ ID NO: 18) | TCGAACTTCTACTAACTCCGTACTACGA (SEQ ID NO: 19) |
| PTGS2 | AF044206 6779 bp-6924 bp (SEQ ID NO: 53) | CGGAAGCGTTCGGGTAAAG (SEQ ID NO: 179) | AATTCCACCGCCCCCAAAC (SEQ ID NO: 54) | (SEQ ID NO: 55) |
| RASSF1A | AC002481 (SEQ ID NO: 21) | 18107 bp-18171 bp (SEQ ID NO: 180) | ATTGAGTTGCGGGAGTTGGT (SEQ ID NO: 22) | ACACGCTCCAACCGAATACG (SEQ ID NO: 23) |
| RNR1 | X01547 (SEQ ID NO: 121) | 219 bp-293 | CGTTTTTGGAGATACGGGTCG (SEQ ID NO: 122) | AAACAACGCCGAACCGAA\ (SEQ ID NO: 123) |
| SOCS1 | U88326 (SEQ ID NO: 25) | 304 bp-397 bp (SEQ ID NO: 181) | GCGTCGAGTTCGTCGGGTATTT (SEQ ID NO: 26) | CCGAAACCATCTTCACGCTAA (SEQ ID NO: 27) |
| SYK | AC021581 (SEQ ID NO: 125) | 123537 bp-123613 bp (SEQ ID NO: 182) | GGGCGCGATATTGGGAG (SEQ ID NO: 126) | GCGACTCTTCCTCATTTTAACAAC (SEQ ID NO: 127) |
| TERT | AF325900 (SEQ ID NO: 129) | 1870 bp-1985 bp | GGATTCGCGGGTATAGACGTT (SEQ ID NO: 130) | CGAAATCCCGCGAAA (SEQ ID NO: 131) |
| TFF1 | AB038162 (SEQ ID NO: 57) | 549 bp-696 bp | TAAGGTTACGGTGTGTTATTTCGTGA (SEQ ID NO: 58) | ACTTAATCCAATTCCTACTCATATCTAAAA (SEQ ID NO: 59) |
| TGFBR2 | U52240 (SEQ ID NO: 61) | 256 bp-333 bp (SEQ ID NO: 183) | GCGCGGAGCCTAGTTAGG (SEQ ID NO: 62) | CAAACCCCCTACTCTGTCAT (SEQ ID NO: 63) |
| THBSI | J04835 (SEQ ID NO: 133) | 1642 bp-1716 bp | CGACGCACCAACCTACCG (SEQ ID NO: 134) | GTTTTGAGTTGGTTTACGTTCGTT (SEQ ID NO: 135) |
| TIMP3 | U33110 (SEQ ID NO: 65) | 1051 bp-1143 | GCGTCGGAGGTTAAGGTTGTT (SEQ ID NO: 66) | CTCTCCAAAATTACCGTACGCG (SEQ ID NO: 67) |

TABLE 2-continued

Data Supplement 2; MethyLight™ Primer and Probe Sequences

| | | | |
|---|---|---|---|
| TNFRSF12 | AB051850 (SEQ ID NO: 69) | GCGGAATTACGACGGGTAGA (SEQ ID NO: 70) | ACTCCATAACCCTCCGACGA (SEQ ID NO: 71) |
| TWIST | AC003986 (SEQ ID NO: 73) | GTAGCGCGGCGAACGT (SEQ ID NO: 74) | AAACGCAACGAATCATAACCAAC (SEQ ID NO: 75) |
| TYMS | D00517 (SEQ ID NO: 137) | CGGCGTTAGGAAGGACGAT (SEQ ID NO: 138) | TCTCAAACTATAACGCGCCTACAT (SEQ ID NO: 139) |
| ACTB | | TGGTGATGGAGGAGGTTTAGTAAGT (SEQ ID NO: 141) | AACCAATAAAACTACTCCTCCCTTAA (SEQ ID NO: 142) |
| ACTB | | TGGTGATGGAGGAGGTTTAGTAAGT (SEQ ID NO: 141) | AACCAATAAAACTACTCCTCCCTTAA (SEQ ID NO: 142) |
| COL2A1 | L10347 (SEQ ID NO: 145) | TCTAACAATTATAAACTCCAACCACCAA (SEQ ID NO: 146) | GGGAAGATGGGATAGAAGGGAATAT (SEQ ID NO: 147) |
| COL2A1 | L10347 (SEQ ID NO: 145) | TCTAACAATTATAAACTCCAACCACCAA (SEQ ID NO: 146) | GGGAAGATGGGATAGAAGGGAATAT (SEQ ID NO: 147) |

| HUGO Gene Nomenclature | Probe Oligo Sequence (SEQ ID NO) |
|---|---|
| ABCB1 | 6FAM-ACGCTATTCCTACCCAACCAATCAACCTCA-BHQ-1 (SEQ ID NO: 80) |
| APC | 6FAM-CCCGTCGAAAACCCGATTA-TAMRA (SEQ ID NO: 32) |
| ARHI | 6FAM-CGCACAAAAACGAAATACGAAAACGCAAA-BHQ-1 (SEQ ID NO: 4) |
| BCL2 | 6FAM-ACGACCCGAAAACAACCGAAATCTACA-BHQ-1 (SEQ ID NO: 8) |
| BRCA1 | 6FAM-CCGGCTTTTCCGTTACCACGA-BHQ-1 (SEQ ID NO: 84) |
| CALCA | 6FAM-ATTCCGCAATACAACAACCAATAAACG-TAMRA (SEQ ID NO: 88) |
| CCND2 | 6FAM-CACGCTCGATCCTTCGCCCGBHq1 (SEQ ID NO: 92) |

TABLE 2-continued

Data Supplement 2; MethyLight™ Primer and Probe Sequences

| Gene | Sequence |
|---|---|
| CDH1 | 6FAM-CGCCCACCCGACCTCGCAT-TAMRA (SEQ ID NO: 96) |
| CDH13 | 6FAM-AACGCAAAACGCGCCCGACA-BHQ-1 (SEQ ID NO: 36) |
| CDKN2A | 6FAM-ACCCGACCCCGAACCGCG-TAMRA (SEQ ID NO: 100) |
| CYP1B1 | 6FAM-CGCCGCACACCAAACCGCTT-BHQ-1 (SEQ ID NO: 12) |
| DAPK1 | 6FAM-CGACCATAAACGCCAACGCCG-BHQ-1 (SEQ ID NO: 104) |
| ESR1 | 6FAM-CGATAAAACCGAACGACCCGACGA-TAMRA (SEQ ID NO: 16) |
| ESR2 | 6FAM-CCGACCCAACGTCGCCG-TAMRA (SEQ ID NO: 40) |
| GSTP1 | 6FAM-AAACCTCGCCGACCTCCGAACCTTATAAAA-TAMRA (SEQ ID NO: 44) |
| HRAS1 | 6FAM-CACTCTTACCCACACGCCGACG-BHQ-1 (SEQ ID NO: 108) |
| HSD17B4 | 6FAM-CCCGCCCGATAACCAATACCA-BHQ-1 (SEQ ID NO: 48) |
| MCJ | 6FAM-TCGCCAACTAAAACGATAACACCACGAACA-BHQ-1 (SEQ ID NO: 112) |
| MGMT | 6FAM-CGCAAACGATACGCACCGCGA-TAMRA (SEQ ID NO: 116) |
| MLH1 | 6FAM-CGCGACGTCAAACGCCACTACG-TAMRA (SEQ ID NO: 52) |
| MYOD1 | 6FAM-CTCCAACACCCGACTACTATATCCGGAAA-TAMRA (SEQ ID NO: 120) |
| PGR | 6FAM-ATCATCTCCGGAAATCTCAAATCCCAATAATACG-TAMRA (SEQ ID NO: 20) |
| PTGS2 | 6FAM-TTTCCGCCAAATATCTTTTCTTTCGCA-BHQ-1 (SEQ ID NO: 56) |
| RASSF1A | 6FAM-CCCTTCCCAACGCGCCCA-BHQ-1 (SEQ ID NO: 24) |

TABLE 2-continued

Data Supplement 2; MethyLight™ Primer and Probe Sequences

| | |
|---|---|
| RNR1 | 6FAM-ACCGCCCGTACCACACGCAAA-BHQ-1 (SEQ ID NO: 124) |
| SOCS1 | 6FAM-ACAATTCCGCTAACGACTATCGCGCA-BHQ-1 (SEQ ID NO: 28) |
| SYK | 6FAM-CCTTAACGCGCCGAACAAACG-BHQ-1 (SEQ ID NO: 128) |
| TERT | 6FAM-CCCAATCCCTCCGCCACGTAAAA-BHQ-1 (SEQ ID NO: 132) |
| TFF1 | 6FAM-CCCTCCCGCCAAAATAAATACTATACTCACTACAAAA-BHQ-1 (SEQ ID NO: 60) |
| TGFBR2 | 6FAM-CACGAACGACGCCTTCCCGAA-TAMRA (SEQ ID NO: 64) |
| THBS1 | 6FAM-ACGCCGGCGCTCACCTCCCT-TAMRA (SEQ ID NO: 136) |
| TIMP3 | 6FAM-AACTCGCTCGCCCGCCGAA-TAMRA (SEQ ID NO: 65) |
| TNFRSF12 | 6FAM-CGCCCAAAAACTTCCCGACTTCCGTA-BHQ-1 (SEQ ID NO: 72) |
| TWIST | 6FAM-CCAACGCACCCAATCGCTAAACGA-BHQ1 (SEQ ID NO: 76) |
| TYMS | 6FAM-CCGAATACCGACAAAATACCGATACCCGT-TAMRA (SEQ ID NO: 140) |
| ACTB | 6FAM-ACCACCACCCAACACACAACAATAACAAACACA-TAMRA (SEQ ID NO: 143) |
| ACTB | 6FAM-ACCACCACCCAACACACAACAATAACAAACACA-BHQ-1 (SEQ ID NO: 144) |
| COL2A1 | 6FAM-CCTTCATTCTAACCCAATACCTATCCCACCTCTAAA-TAMRA (SEQ ID NO: 148) |
| COL2A1 | 6FAM-CCTTCATTCTAACCCAATACCTATCCCACCTCTAAA-BHQ-1 (SEQ ID NO: 149) |
| // // // | |

TABLE 3

Data Supplement 3; Quantitative Real-Time RT-PCR Primer and Probe Sequences

| HUGO GENE NOMEN-CLATURE | GENE NAME | FORWARD PRIMER SEQUENCE (SEQ ID NO) | REVERSE PRIMER SEQUENCE (SEQ ID NO) |
|---|---|---|---|
| ESR1 | Estrogen Receptor transcribed exon 1_2 | CGGCATTCTACAGGCCAAAT (SEQ ID NO: 150) | CCTTGTCATTGGTACTGGCCA (SEQ ID NO: 151) |
| ESR1 | Estrogen Receptor alpha upstream transcript A | TAACCTCGGGCTGTGCTCTT (SEQ ID NO: 153) | GCAGGGCAGAAGGCTCAG (SEQ ID NO: 154) |
| ESR1 | Estrogen Receptor alpha upstream transcript B | CAGCCTCTATCCAGCAGCG (SEQ ID NO: 156) | CAGGGCAGAAGGCTCAGAAA (SEQ ID NO: 157) |
| ESR1 | Estrogen Receptor alpha upstream transcript C | TTCTGGAAAGACGTTCTTGATCC (SEQ ID NO: 159) | CCCGCAGGGCAGAAGG (SEQ ID NO: 160) |
| ESR1 | Estrogen Receptor alpha upstresm transcript D | TCTTTACCCTTCTTCACCTGAGAGA (SEQ ID NO: 162) | CGCAGGGCAGAAGGCTC (SEQ ID NO: 163) |
| ESR1 | Estrogen Receptor alpha upstream transcript E | TTAATCTGAACTTTGAACCATCACTGAG (SEQ ID NO: 165) | AGGGTGCAGACCGTGTCC (SEQ ID NO: 166) |
| TBP | Tata Box binding protein | CACGAACCACGGCACTGATT (SEQ ID NO: 165) | TTTTCTTGCTGCCAGTCTGGAC (SEQ ID NO: 169) |

//
//
//
//
//
//
//
//
//

| HUGO GENE NOMEN-CLATURE | PROBE OLIGO SEQUENCE (SEQ ID NO) |
|---|---|
| ESR1 | 6FAM-TGCCACCCTGGCGTCGATTATCTG-TAMRA (SEQ ID NO: 152) |
| ESR1 | 6FAM-CCAGGTGGCCCGCCGGTT-TAMRA (SEQ ID NO: 155) |
| ESR1 | 6FAM-CGACAAGTAAAGTGGCCCGCCG-TAMRA (SEQ ID NO: 158) |
| ESR1 | 6FAM-AGAAACCGGCGGGCCACCCT-TAMRA (SEQ ID NO: 161) |
| ESR1 | 6FAM-CCAGTGGCCCGCCGGTTTC-TAMRA (SEQ ID NO: 164) |
| ESR1 | 6FAM-CCCGCCGGTTTCTGAGCCTTCT-TAMRA (SEQ ID NO: 167) |
| TBP | 6FAM-TGTGCACAGGAGCCAAGAGTGAAGA-TAMRA (SEQ ID NO: 170) |

//
//
//
//
//
//
//
//
//

Example 2

MethyLight™ Analysis, Using 35 Informative DNA Methylation Markers, was Performed on 148 Primary Breast Carcinomas to Identify Novel Clustering Based on Methylation and HR Status In this EXAMPLE, MethyLight™ analyses, using 35 informative DNA methylation markers, was performed on 148 primary breast carcinomas. The analyses revealed two major tumor clusters, based on distinct methylation profiles, that also differed significantly in their hormone receptor (HR) status.

Sixty-five (65) DNA methylation markers were initially pre-screened on a limited set of pilot samples (8 breast cancer cell lines and 8 breast carcinomas) to identify markers with sufficiently high methylation frequencies and/or methylation levels. From this initial set, 35 informative markers were selected for MethyLight™ analysis on 148 primary breast carcinomas obtained from the University Hospital of the University of Innsbruck, Austria (a summary of clinical characteristics shown in TABLE 1).

A semi-automated MethyLight™ platform (EXAMPLE 1 herein above, under "DNA methylation analyses") was used to execute these reactions, and data was obtained for 4,978 of the 5,180 analyses performed (96% success rate). A summary of the data is shown in the following TABLE 4 (Data Supplement 4):

Two-dimensional unsupervised hierarchical clustering analysis (EXAMPLE 1 above, under "Statistics") of cases versus methylation markers revealed that the tumors segregated naturally into groups of cases with distinct methylation profiles and hormone receptor (HR) status (FIG. 1).

Specifically, FIG. 1 shows, according to particular aspects of the present invention, unsupervised Hierarchical Clustering of DNA Methylation Markers and breast Carcinomas. Agglomerative hierarchical analysis was used to cluster samples (columns) and DNA methylation gene markers (rows) as listed on the right. Quartiles of DNA methylation measures (PMR values) are indicated by color, ranging from dark green indicating the lowest methylation (first quartile), and light green, light red and dark red indicating the second, third and fourth (highest methylation) quartiles, respectively. Failed analyses are indicated in white. The two major sample clusters are shown in green (cluster 1) and red (cluster 2). Hormone receptor status (HR) is indicated by black ovals (HR negative) or white ovals (HR positive).

These two major clusters differed significantly in their hormone receptor (HR) status: [p=0.0011 for cluster 1 (indicated on the upper left; in green) (n=87) versus cluster 2 (indicated on the upper right; in red) (n=56) for ER+ vs. ER−; p=0.0013 for PR+ vs. PR−; p=0.0011 for HR+ vs. HR−]; and in age [p=0.0080 for cluster 1 versus cluster 2; mean age 57 versus 63 years, respectively].

Adjustments for age were accordingly made in all subsequent analyses. No significant clustering of cases was detected, based on HER2 status (Slamon, et al., *Science*, 235:177-182, 1987), menopausal status, relapse, death, grade, nodes, stage or tumor diameter (data not shown).

TABLE 4

Data Supplement 4; Gene (marker) List and DNA Methylation Data Overview

| Gene | Full Name | % Positive DNA Methylation | Median PMR of Positives |
|---|---|---|---|
| ABCB1 | ATP-binding cassette, sub-family B (MDR/TAP), member 1 | 100 | 21.0 |
| APC | adenomatosis polyposis *coli* | 86.4 | 6.7 |
| ARHI | ras homolog gene family, member I | 99.3 | 43.2 |
| BCL2 | B-cell CLL/lymphoma 2 | 17.5 | 2.5 |
| BRCA1 | breast cancer 1, early onset | 25.9 | 0.4 |
| CALCA | calcitonin/calcitonin-related polypeptide, alpha | 97.9 | 2.0 |
| CCND2 | cyclin D2 | 84.7 | 1.8 |
| CDH1 | cadherin 1, type 1, E-cadherin | 56.4 | 0.2 |
| CDH13 | cadherin 13, H-cadherin | 95.9 | 1.6 |
| CDKN2A | cyclin-dependent kinase inhibitor 2A | 100 | 0.4 |
| CYP1B1 | cytochrome P450, subfamily I (dioxin-inducible), | 38.2 | 0.05 |
| DAPK1 | death-associated protein kinase 1 | 93.7 | 0.9 |
| ESR1 | estrogen receptor 1 | 100 | 0.8 |
| ESR2 | estrogen receptor 2 (ER beta) | 79.0 | 0.1 |
| GSTP1 | glutathione S-transferase pi | 65.5 | 3.8 |
| HRAS | v-Ha-ras Harvey rat sarcoma viral oncogene homolog | 100 | 230.6 |
| HSD17B4 | hydroxysteroid (17-beta) dehydrogenase 4 | 82.1 | 0.2 |
| MCJ | methylation-controlled J protein | 99.3 | 6.4 |
| MGMT | O-6-methylguanine-DNA methyltransferase | 10.3 | 0.8 |
| MLH1 | mutL homolog 1 | 31.7 | 0.1 |
| MYOD1 | myogenic factor 3 | 89.5 | 2.0 |
| PGR | progesterone receptor | 100 | 0.6 |
| PTGS2 | prostaglandin-endoperoxide synthase 2 | 99.3 | 12.2 |
| RASSF1A | Ras association (RalGDS/AF-6) domain family 1A | 98.6 | 43.6 |
| RNR1 | RNA, ribosomal 1 | 100 | 116.7 |
| SOCS1 | suppressor of cytokine signaling 1 | 57.6 | 0.4 |
| SYK | spleen tyrosine kinase | 88.6 | 0.1 |
| TERT | telomerase reverse transcriptase | 54.1 | 7.5 |
| TFF1 | trefoil factor 1 | 98.6 | 40.2 |
| TGFBR2 | transforming growth factor, beta receptor II | 29.7 | 0.7 |
| THBS1 | thrombospondin 1 | 6.1 | 0.003 |
| TIMP3 | tissue inhibitor of metalloproteinase 3 | 90.6 | 0.4 |
| TNFRSF12 | tumor necrosis factor receptor superfamily, member 12 | 100 | 91.9 |
| TWIST | twist homolog | 87.0 | 3.0 |
| TYMS | thymidylate synthetase | 4.7 | 0.009 |

As discussed herein above (under "Background"), molecular profiling of breast cancer using gene expression profiles has revealed five distinct clusters, comprised of one basal-like, one ERBB2-overexpressing, two luminal-like, and one normal breast tissue-like subgroup (Sorlie, T., et al., *Proc Natl Acad Sci USA*, 100:8418-8423, 2003). Because applicants have not performed gene expression microarray experiments on the instant group of breast tumors, the present DNA methylation clustering results cannot be directly compared to the five major groups identified by gene expression profiles. However, it seems likely that the DNA methylation cluster 2, which contains mostly hormone receptor-positive tumors (FIG. 1), overlaps with the two luminal-like subgroups, which contain estrogen-receptor positive tumors (Perou, et al., *Nature*, 406:747-752, 2000). The DNA methylation cluster 1 contains the majority of hormone receptor negative tumors, and likely overlaps with the other three gene expression subtypes, which tend to be ER negative (Perou, et al., *Nature*, 406:747-752, 2000). It seems likely that the gene expression profile subgroupings represent a much more stable subgrouping, since these analyses are based on a much larger number of samples and genes (Sorlie, T., et al., *Proc Natl Acad Sci USA*, 100:8418-8423, 2003).

Nevertheless, the undirected clustering of applicants' instant methylation data led to the identification of a novel and interesting link between DNA methylation patterns and hormone receptor biology.

Example 3

The Association of Each of the 35 Markers of EXAMPLE 2 was Individually Investigated with Respect to Hormone Receptor Status, and Ranked According to the Strength of Their Association In this EXAMPLE, the 35 DNA methylation markers of EXAMPLE 2 were ranked according to the strength of their association with hormone receptor status (HR, ER, and PR, in which HR refers to ER and/or PR positivity). Three markers (SOCS1, RASSF1A and BCL2) were significantly associated with (the best predictors of) HR status (TABLE 5, column "A"), whereas neither ESR1 nor PGR methylation markers were good predictors of overall HR status, but were each the best predictor of the status of the other receptor, but not of their own cognate receptor (TABLE 5).

The hierarchical clustering data obtained under EXAMPLE 2 indicated that hormone receptor status is associated with profiles of multiple methylation markers, but it does not reveal which markers contribute most to the clustering.

The association of each of the 35 markers was, therefore, individually investigated with respect to hormone receptor status, and ranked according to the strength of their association. The ranking is shown in TABLE 5:

TABLE 5

DNA Methylation Markers as Predictors of Hormone Receptor Status

| A HR Status Predictors | | | B ER Status Predictors | | | C PR Status Predictors | | |
|---|---|---|---|---|---|---|---|---|
| Gene | Association | P-value | Gene | Association | P-value | Gene | Association | P-value |
| SOCS1 | + | 0.0001 | PGR | − | 0.0010 | ESR1 | + | 0.0118 |
| RASSF1A | + | 0.0002 | TFF1 | − | 0.0035 | TGFBR2 | + | 0.0218 |
| BCL2 | − | 0.0009 | CDH13 | − | 0.0043 | PTGS2 | + | 0.0295 |
| PGR | − | 0.0022 | TIMP3 | − | 0.0063 | CDH13 | + | 0.0326 |
| TGFBR2 | + | 0.0023 | HSD17B4 | − | 0.0110 | SOCS1 | + | 0.0581 |
| GSTP1 | + | 0.0033 | ESR1 | − | 0.0330 | TFF1 | + | 0.0626 |
| PTGS2 | + | 0.0037 | BCL2 | − | 0.0496 | GSTP1 | + | 0.1238 |
| HSD17B4 | − | 0.0053 | APC | + | 0.0552 | TWIST | + | 0.1287 |
| ARHI | + | 0.0085 | CDH1 | − | 0.0653 | RASSF1A | + | 0.1491 |
| APC | + | 0.0151 | TERT | − | 0.0671 | PGR | + | 0.1763 |
| TIMP3 | − | 0.0177 | MCJ | + | 0.0772 | CDH1 | + | 0.1948 |
| TWIST | + | 0.0224 | RASSF1A | + | 0.1223 | MLH1 | + | 0.2000 |
| MLH1 | + | 0.0369 | SOCS1 | + | 0.1463 | ESR2 | + | 0.2685 |
| ESR2 | + | 0.0414 | CDKN2A | − | 0.1748 | ARHI | + | 0.2954 |
| TNFRSF12 | + | 0.0452 | RNR1 | + | 0.2322 | HRAS | − | 0.2962 |
| TFF1 | − | 0.0564 | ARHI | + | 0.2470 | CCND2 | + | 0.2976 |
| SYK | − | 0.0812 | ABCB1 | + | 0.3798 | HSD17B4 | + | 0.3781 |
| CDH13 | − | 0.0853 | TGFBR2 | + | 0.4330 | TNFRSF12 | + | 0.4491 |
| RNR1 | + | 0.1088 | CALCA | − | 0.4691 | TERT | + | 0.4558 |
| CDKN2A | − | 0.1282 | CCND2 | − | 0.4915 | TIMP3 | + | 0.4590 |
| MCJ | + | 0.1324 | MGMT | − | 0.5157 | DAPK1 | + | 0.4996 |
| TERT | − | 0.1465 | HRAS | + | 0.5212 | MCJ | − | 0.5811 |
| MGMT | − | 0.2350 | GSTP1 | + | 0.5219 | BCL2 | − | 0.5980 |
| CDH1 | − | 0.2674 | SYK | − | 0.5333 | THBS1 | − | 0.6297 |
| HRAS | − | 0.3155 | TNFRSF12 | + | 0.5517 | ABCB1 | − | 0.6560 |
| CALCA | − | 0.3796 | BRCA1 | − | 0.5741 | SYK | − | 0.7178 |
| CYP1B1 | − | 0.3954 | MLH1 | + | 0.6753 | TYMS | − | 0.7404 |
| THBS1 | − | 0.4210 | ESR2 | + | 0.7660 | CYP1B1 | − | 0.7750 |
| BRCA1 | − | 0.5164 | TYMS | + | 0.8311 | CALCA | − | 0.8015 |
| DAPK1 | + | 0.5700 | PTGS2 | + | 0.8563 | MGMT | − | 0.8400 |
| CCND2 | + | 0.7342 | CYP1B1 | − | 0.8907 | CDKN2A | + | 0.8522 |
| TYMS | + | 0.7771 | DAPK1 | + | 0.9232 | BRCA1 | + | 0.8717 |
| ABCB1 | + | 0.7861 | THBS1 | − | 0.9411 | APC | − | 0.9011 |
| MYOD1 | + | 0.8096 | MYOD1 | + | 0.9441 | RNR1 | + | 0.9213 |
| ESR1 | − | 0.8737 | TWIST | − | 0.9671 | MYOD1 | − | 0.9751 |

The 35 DNA methylation markers were ranked according to the strength of their association with hormone receptor status as determined by the art-recognized Mann-Whitney U test (a nonparametric equivalent of Student's t-test). Hormone receptor status (HR, ER, and PR, in which HR refers to ER and/or PR positivity) was used as the outcome, and quartiled DNA methylation (PMR) values were used as predictors, with adjustment for age. Significant associations would encompass, as recognized in the art (see, e.g., Wacholder et al., Commentary, *J. Nat. Cancer Inst.*, 96:434-442, 2004), those markers having P-values $\leq 0.05$; where "Association" refers to the direction of the association, with a "+" indicating a positive relationship between DNA methylation and hormone receptor status, and a "−" indicating an inverse relationship. In the ER analysis, the data were adjusted for PR status, while in the PR analysis, the data were adjusted for ER status Fifteen out of the 35 genes (methylation markers) yielded P-values $\leq 0.05$ using Percent of Methylated Reference (PMR) values (measured as described in EXAMPLE 1, "Materials and Methods") as predictors of HR status (ER-positive and/or PR-positive) (TABLE 5, column "A").

In particularly preferred aspects of the present invention, associations are determined in a particularly stringent manner, after optional adjustment for multiple comparisons was done by controlling the false-discovery rate, which is the expected proportion of false-positive tests among all positive tests (see description, including citations in EXAMPLE 1, under "Statistics"), and are indicated in TABLE 5 in bold-face type. After this optional multiple comparison adjustment, three (SOCS1, RASSF1A and BCL2) of the 15 significant markers (3 out of the original 35 markers) were even more significantly associated with HR status (TABLE 5, column "A").

Therefore, according to particular aspects, 15 of the 35 methylation markers (those with P-values $\leq 0.050$) were demonstrated to have utility for predicting HR status, along with combinations of any of these 15 markers. Preferably, the markers are selected from the group consisting of SOCS1, RASSF1A, BCL2 and combinations thereof.

Additionally, seven (7) of the 35 methylation markers (or combinations thereof) were demonstrated to have utility for predicting ER status, and four (4) of the 35 methylation markers (or combinations thereof) were demonstrated to have utility for predicting PR status. Preferably, methylation of PGR is used for predicting ER status, and methylation of ESR1 is used for predicting PR status (TABLE 5, columns "B" and "C," respectively).

Interestingly, SOCS1 deficiency results in accelerated mammary gland development in mice (Lindeman, et al., *Genes Dev*, 15:1631-1636, 2001), and is known to be methylated in human tumors (Yoshikawa, et al., *Nat Genet*, 28:29-35, 2001).

Promoter methylation of RASSP1A has previously been reported to be methylated in a large percentage of human breast cancers (Dammann, et al., *Cancer Res*, 61:3105-3109, 2001), and this methylation can even be detected in epithelial hyperplasia and intraductal papillomas (Lehmann, et al., *Am J Pathol*, 160:605-612, 2002). Significantly, applicants show herein that RASSF1A promoter methylation is associated with hormone receptor status in advanced breast tumors.

Additionally, applicants have identified a novel significant negative association between BCL2 methylation and hormone receptor status. This result is consistent with earlier reports that BCL2 expression is positively associated with hormone receptor positivity (Castiglione, et al., *Anticancer Res*, 19:4555-4563, 1999), and that its down-regulation is negatively associated with hormone receptor positivity (Park, et al., *Pathol Oncol Res*, 8:26-30, 2002).

Remarkably, of all 35 markers, DNA methylation of the ESR1 gene, encoding the estrogen receptor alpha, was the least associated with HR status. PGR methylation was also not significantly associated with HR status after adjustment for multiple comparisons. Breast tumors are often concordant for ER and PR status. In the instant study, 121 out of 148 breast cancer specimens were either double receptor (ER and PR) positive (86) or double receptor negative (41), while only 21 tumors were positive for either just ER (12) or PR (9). This highly significant association ($p=2.6 \times 10^{-16}$ by Chi-Square) between ER and PR status is attributed to induction of PGR gene expression by activated ER (Savouret, et al., *Embo J*, 10:1875-1883, 1991, Clark, et al., *J Clin Oncol*, 2:1102-1109, 1984). This makes it difficult to separate the effects of the two receptors. The effects of the ER and PR receptors were separated by investigating which methylation markers best predict the status of ER and PR individually, while adjusting for the status of the other receptor and for age (TABLE 5 columns "B" and "C").

Interestingly, methylation of the 5'CpG island the PGR gene turned out to be the best predictor of ER status (TABLE 5, column "B"). Positive ER status is inversely associated with PGR CpG island methylation, consistent with the well-established induction of PGR gene expression by activated ER (Nardulli, et al., *Endocrinology*, 122:935-944, 1988).

On the other hand, ESR1 methylation turned out to be the best predictor of PR status (TABLE 5, column "C"), even though it is the least significant predictor of overall HR status (TABLE 5, column "A").

Thus, while neither ESR1 nor PGR methylation markers were good predictors of overall HR status, they are each the best predictor of the status of the other receptor, but not of their own cognate receptor.

Example 4

Figure 2:
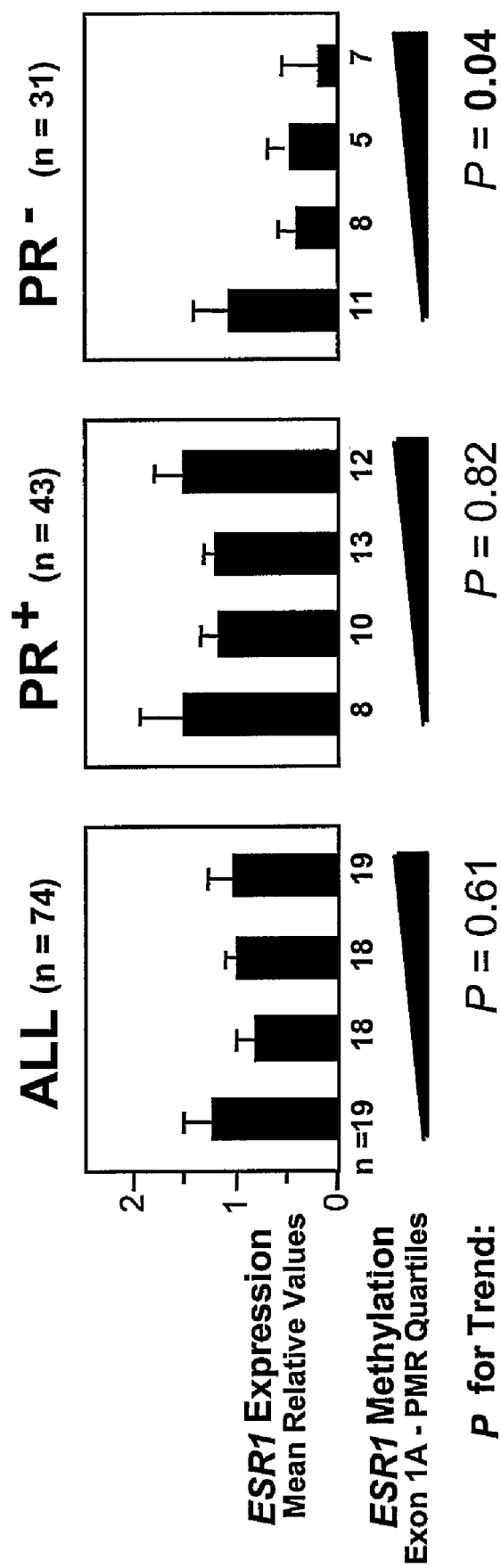
FIG. 2 shows, according to exemplary aspects, ESR1 gene expression and ESR1 DNA methylation. Progesterone-negative (PR−) tumors showed a statistically significant inverse trend between ESR1 gene expression levels and ESR1 methylation levels (rightmost panel).

Progesterone Receptor-Negative (PR−) Tumors Showed a Statistically Significant Inverse Trend Between ESR1 Gene Expression Levels and ESR1 Methylation Levels This EXAMPLE shows, according to the present invention, that there was no clear inverse relationship between ESR1 expression levels and quartiled ESR1 methylation levels when the tumors were analyzed collectively (FIG. 2, left panel). However, PR− tumors showed a statistically significant inverse trend between ESR1 gene expression levels and ESR1 methylation levels (FIG. 2, rightmost panel).

As shown above, under EXAMPLE 3, while neither ESR1 nor PGR methylation markers were good predictors of overall HR status, they are each the best predictor of the status of the other receptor, but not of their own cognate receptor. It is not a priori clear why this would be the case, or why there would be a positive association between PR status and ESR1 methylation (TABLE 5, column "C"), since activated ER is known to induce PGR gene expression. This raised the question of whether ESR1 methylation is truly reflective of reduced ESR1 expression.

ESR1 expression was analyzed by quantitative real-time RT-PCR in 74 samples for which applicants had frozen tissue available for RNA analysis (FIG. 2).

FIG. 2 shows, according to particular aspects, a comparison of ESR1 gene expression and ESR1 DNA methylation. ESR1 gene expression from Exon 1A was measured by real-time quantitative RT-PCR, and the resulting values were divided by the expression values for the control gene TBP and normalized to a mean ratio of 1.0 across all 74 samples. Methylation levels were measured immediately downstream of the transcription start site of Exon 1A (amplicon located from +14 to +114) by MethyLight™, and the resulting PMR values were divided into quartiles. The leftmost panel shows the comparison, by quartile, among "All" (PR+ and PR−, collectively) the 74 analyzed tumors, whereas in the two panels on the right, the four quartiles were further subdivided into progesterone receptor-positive (PR+) and progesterone receptor-negative (PR−) tumors.

There was no clear inverse relationship between ESR1 expression levels and quartiled ESR1 methylation levels when the tumors were analyzed collectively (FIG. 2, left panel). However, PR− tumors showed a statistically significant inverse trend between ESR1 gene expression levels and ESR1 methylation levels (FIG. 2, rightmost panel). This suggests that PR positive status may confer resistance of the ESR1 gene expression to ESR1 DNA methylation.

It should be noted that the levels of methylation that we observed at the ESR1 locus are quite low, with a median PMR of 0.8 (TABLE 4 (Data Supplement 4), under EXAMPLE 2), and may therefore be more of a reflection of chromatin status at the ESR1 locus, rather than a major driving force in silencing ESR1 gene expression. Regardless, it is yet another intriguing finding of an interaction between DNA methylation and hormone receptor biology.

Transcriptional repression by promoter DNA methylation is thought to be mediated through changes in chromatin structure. The association between DNA methylation and gene expression may therefore show threshold effects, rather than a simple linear relationship. Indeed, robust ESR1 expression in PR− tumors is seen only in the lowest quartile of ESR1 methylation (FIG. 2). The lack of observed effect of ESR1 methylation on ESR1 expression in PR+ tumors (FIG. 2) is interesting. As mentioned earlier, the PMR values obtained for ESR1 methylation are very low, with a median PMR of 0.8, which may not be sufficiently high to cause gene silencing. Moreover, the particular implementation of the ESR1 methylation assay (MethyLight™) used herein is located immediately downstream of the transcription start site for Exon 1A of the ESR1 gene (+14 to +114), rather than in the promoter region itself. However, PR− tumors did show the expected inverse relationship between ESR1 methylation and expression with these same assays (FIG. 2).

Others have shown that ESR1 gene expression can be activated in ER negative cell lines by DNA methyltransferase and HDAC inhibitors (Yang, et al., Cancer Res, 61:7025-7029, 2001). One hypothesis that could reconcile these disparate observations is that PR+ tumors rely more extensively on expression initiating at upstream exons of the ESR1 gene (Kos, et al., Mol Endocrinol, 15:2057-2063, 2001). Expression driven from these upstream promoters would not be expected to be affected by the DNA methylation measured at exon 1A (Jones, P.A., Trends Genet, 15:34-37, 1999). Indeed, applicants have identified several putative progesterone response elements located near upstream Exon 1C.

However, the relative utilization of ESR1 exons 1A, 1B, 1C, 1D, and 1E was found by applicants herein to be similar in PR+ and PR− tumors. A summary of this analysis is shown in TABLES 6, 7 and 8 (Data Supplement 5), below.

TABLE 6

Data Supplement 5; Mean expression levels measured at different exons of the ESR1 gene, split by quartiles of ESR1 methylation. Outcome: Ratio of expression/mean (expression) using 74 observations; Adjusted for age.

| | Mean of All | Standard Error | Mean of ESR1 Methylation Quartile 1 | Stand. Error | Mean of ESR1 Methylation Quartile 2 | Stand. Error | Mean of ESR1 Methylation Quartile 3 | Stand. Error | Mean of ESR1 Methylation Quartile 4 | Stand. Error | P-Value for Trend (a) | Rank P-Value for Trend (b) | P-Value for Heterogeneity Test (c) | Rank P-Value for Heterogeneity Test (d) |
|---|---|---|---|---|---|---|---|---|---|---|---|---|---|---|
| Overall | | | | | | | | | | | | | | |
| Exon 1-2 | 1.01 | 0.09 | 1.30 | 0.28 | 0.88 | 0.15 | 1.03 | 0.14 | 0.86 | 0.16 | 0.15 | 0.39 | | |
| Exon 1A | 1.01 | 0.11 | 1.23 | 0.28 | 0.80 | 0.16 | 0.99 | 0.13 | 1.00 | 0.27 | 0.61 | 0.72 | | |
| Exon 1B | 1.01 | 0.11 | 1.23 | 0.24 | 0.82 | 0.15 | 0.89 | 0.17 | 1.12 | 0.33 | 0.82 | 0.46 | | |
| Exon 1C | 1.01 | 0.13 | 0.99 | 0.23 | 0.92 | 0.19 | 1.05 | 0.24 | 1.08 | 0.37 | 0.70 | 0.72 | | |
| Exon 1D | 1.01 | 0.13 | 1.11 | 0.24 | 0.88 | 0.18 | 0.96 | 0.21 | 1.06 | 0.40 | 0.90 | 0.43 | | |
| Exon 1E | 1.00 | 0.07 | 1.21 | 0.15 | 0.75 | 0.09 | 0.97 | 0.11 | 1.03 | 0.16 | 0.49 | 0.60 | | |
| PR negative | | | | | | | | | | | | | | |
| Exon 1-2 | 0.66 | 0.14 | 1.09 | 0.36 | 0.46 | 0.17 | 0.67 | 0.26 | 0.27 | 0.20 | 0.04 | 0.06 | | |
| Exon 1A | 0.57 | 0.15 | 1.04 | 0.36 | 0.38 | 0.18 | 0.47 | 0.19 | 0.16 | 0.37 | 0.04 | 0.03 | | |
| Exon 1B | 0.64 | 0.17 | 0.92 | 0.30 | 0.53 | 0.20 | 0.76 | 0.32 | 0.26 | 0.49 | 0.20 | 0.10 | | |
| Exon 1C | 0.58 | 0.19 | 0.63 | 0.28 | 0.62 | 0.26 | 0.95 | 0.47 | 0.24 | 0.57 | 0.61 | 0.24 | | |
| Exon 1D | 0.56 | 0.19 | 0.77 | 0.30 | 0.39 | 0.21 | 1.02 | 0.41 | 0.12 | 0.61 | 0.38 | 0.13 | | |
| Exon 1E | 0.79 | 0.10 | 1.10 | 0.19 | 0.50 | 0.10 | 0.64 | 0.19 | 0.73 | 0.26 | 0.15 | 0.20 | | |
| PR positive | | | | | | | | | | | | | | |
| Exon 1-2 | 1.25 | 0.12 | 1.60 | 0.43 | 1.23 | 0.16 | 1.17 | 0.16 | 1.21 | 0.15 | 0.29 | 0.40 | 0.40 | 0.40 |
| Exon 1A | 1.32 | 0.13 | 1.50 | 0.43 | 1.17 | 0.17 | 1.19 | 0.12 | 1.50 | 0.29 | 0.82 | 0.99 | 0.09 | 0.11 |
| Exon 1B | 1.27 | 0.14 | 1.67 | 0.36 | 1.06 | 0.18 | 0.94 | 0.20 | 1.63 | 0.37 | 0.89 | 0.43 | 0.30 | 0.50 |
| Exon 1C | 1.32 | 0.16 | 1.51 | 0.33 | 1.19 | 0.24 | 1.09 | 0.29 | 1.59 | 0.44 | 0.77 | 0.51 | 0.57 | 0.68 |
| Exon 1D | 1.33 | 0.16 | 1.60 | 0.35 | 1.31 | 0.19 | 0.93 | 0.25 | 1.61 | 0.47 | 0.90 | 0.25 | 0.57 | 0.73 |
| Exon 1E | 1.16 | 0.08 | 1.37 | 0.23 | 0.96 | 0.10 | 1.09 | 0.12 | 1.21 | 0.20 | 0.70 | 0.63 | 0.42 | 0.54 |

(a) Tests for trend across 4 quartiles of ESR1 methylation (Q1-Q4
(b) Same as (a), but uses ranks of normalized expression value
(c) Tests for heterogeneity of trend between PR negative and PR positive
(d) Same as (c), but uses ranks of normalized expression value

TABLE 7

| Data Supplement 5 cont. (normalized). | | | | | | |
|---|---|---|---|---|---|---|
| OVERALL | | | | | | |
| | PR negative (n = 31) adjusted mean | sem | PR positive (n = 43) adjusted mean | sem | t-test p-value | p-value* |
| Ex 1-2 | 0.7 | 0.1 | 1.3 | 0.1 | 0.0016 | 0.0000 |
| upstream A | 0.6 | 0.2 | 1.3 | 0.1 | 0.0004 | 0.0000 |
| upstream B | 0.6 | 0.2 | 1.3 | 0.1 | 0.0053 | 0.0000 |
| upstream C | 0.6 | 0.2 | 1.3 | 0.2 | 0.0038 | 0.0000 |
| upstream D | 0.6 | 0.2 | 1.3 | 0.2 | 0.0032 | 0.0000 |
| upstream E | 0.8 | 0.1 | 1.2 | 0.1 | 0.0057 | 0.0007 |
| ESR1 methylation-- lowest quartile | | | | | | |
| | PR negative (n = 11) adjusted mean | sem | PR positive (n = 8) adjusted mean | sem | t-test p-value | p-value* |
| Ex 1-2 | 1.1 | 0.4 | 1.6 | 0.4 | 0.3765 | 0.0955 |
| upstream A | 1.0 | 0.4 | 1.5 | 0.4 | 0.4324 | 0.1799 |
| upstream B | 0.9 | 0.3 | 1.7 | 0.4 | 0.1339 | 0.0472 |
| upstream C | 0.6 | 0.3 | 1.5 | 0.3 | 0.0568 | 0.0245 |
| upstream D | 0.8 | 0.3 | 1.6 | 0.4 | 0.0863 | 0.0274 |
| upstream E | 1.1 | 0.2 | 1.4 | 0.2 | 0.3745 | 0.2079 |
| ESR1 methylation-- Q2 (omitting outlier) | | | | | | |
| | PR negative (n = 8) adjusted mean | sem | PR positive (n = 10) adjusted mean | sem | t-test p-value | p-value* |
| Ex 1-2 | 0.5 | 0.2 | 1.2 | 0.2 | 0.0037 | 0.0032 |
| upstream A | 0.4 | 0.2 | 1.2 | 0.2 | 0.0047 | 0.0035 |
| upstream B | 0.5 | 0.2 | 1.1 | 0.2 | 0.0618 | 0.0076 |
| upstream C | 0.6 | 0.3 | 1.2 | 0.2 | 0.1138 | 0.0041 |
| upstream D | 0.4 | 0.2 | 1.3 | 0.2 | 0.0044 | 0.0003 |
| upstream E | 0.5 | 0.1 | 1.0 | 0.1 | 0.0048 | 0.0055 |
| ESR1 methylation-- Q3 | | | | | | |
| | PR negative (n = 5) adjusted mean | sem | PR positive (n = 13) adjusted mean | sem | t-test p-value | p-value* |
| Ex 1-2 | 0.7 | 0.3 | 1.2 | 0.2 | 0.1229 | 0.0705 |
| upstream A | 0.5 | 0.2 | 1.2 | 0.1 | 0.0051 | 0.0030 |
| upstream B | 0.8 | 0.3 | 0.9 | 0.2 | 0.6562 | 0.1198 |
| upstream C | 0.9 | 0.5 | 1.1 | 0.3 | 0.8006 | 0.2484 |
| upstream D | 1.0 | 0.4 | 0.9 | 0.3 | 0.8570 | 0.3873 |
| upstream E | 0.6 | 0.2 | 1.1 | 0.1 | 0.0594 | 0.0646 |
| ESR1 methylation-- highest quartile | | | | | | |
| | PR negative (n = 7) adjusted mean | sem | PR positive (n = 12) adjusted mean | sem | t-test p-value | p-value* |
| Ex 1-2 | 0.3 | 0.2 | 1.2 | 0.2 | 0.0017 | 0.0013 |
| upstream A | 0.2 | 0.4 | 1.5 | 0.3 | 0.0117 | 0.0007 |
| upstream B | 0.3 | 0.5 | 1.6 | 0.4 | 0.0391 | 0.0061 |
| upstream C | 0.2 | 0.6 | 1.6 | 0.4 | 0.0770 | 0.0105 |
| upstream D | 0.1 | 0.6 | 1.6 | 0.5 | 0.0708 | 0.0030 |
| upstream E | 0.7 | 0.3 | 1.2 | 0.2 | 0.1557 | 0.1089 |

Outcome: Ratio of expression/mean (expression)--using 74 observations (one omitted)

*using rank of expression values

TABLE 8

| Data Supplement 5 cont.(by ESR1 methylation) | | | | | |
|---|---|---|---|---|---|
| ESR1 methylation-- lowest quartile | | | | | |
| | PR negative (n = 11) adjusted mean | sem | PR positive (n = 8) adjusted mean | sem | t-test p-value | p-value* |
|---|---|---|---|---|---|---|
| Ex 1-2 | 12.1 | 4.0 | 17.7 | 4.8 | 0.3765 | 0.0955 |
| upstream A | 52.3 | 18.3 | 75.1 | 21.7 | 0.4324 | 0.1799 |
| upstream B | 7.3 | 2.4 | 13.1 | 2.8 | 0.1339 | 0.0472 |
| upstream C | 8.4 | 3.7 | 20.2 | 4.4 | 0.0568 | 0.0245 |
| upstream D | 2.5 | 1.0 | 5.3 | 1.2 | 0.0863 | 0.0274 |
| upstream E | 3.2 | 0.6 | 4.0 | 0.7 | 0.3745 | 0.2079 |
| ESR1 methylation-- Q2 (omitting outlier) | | | | | | |
| | PR negative (n = 8) adjusted mean | sem | PR positive (n = 10) adjusted mean | sem | t-test p-value | p-value* |
| Ex 1-2 | 5.1 | 1.9 | 13.7 | 1.8 | 0.0037 | 0.0032 |
| upstream A | 18.8 | 9.0 | 58.7 | 8.4 | 0.0047 | 0.0035 |
| upstream B | 4.2 | 1.6 | 8.4 | 1.4 | 0.0618 | 0.0076 |
| upstream C | 8.3 | 3.4 | 16.0 | 3.2 | 0.1138 | 0.0041 |
| upstream D | 1.3 | 0.7 | 4.3 | 0.6 | 0.0044 | 0.0003 |
| upstream E | 1.5 | 0.3 | 2.8 | 0.3 | 0.0048 | 0.0055 |
| ESR1 methylation-- Q3 | | | | | | |
| | PR negative (n = 5) adjusted mean | sem | PR positive (n = 13) adjusted mean | sem | t-test p-value | p-value* |
| Ex 1-2 | 7.5 | 2.9 | 13.0 | 1.8 | 0.1229 | 0.0705 |
| upstream A | 23.4 | 9.4 | 59.7 | 5.9 | 0.0051 | 0.0030 |
| upstream B | 6.0 | 2.6 | 7.4 | 1.6 | 0.6562 | 0.1198 |
| upstream C | 12.7 | 6.2 | 14.6 | 3.9 | 0.8006 | 0.2484 |
| upstream D | 3.4 | 1.3 | 3.1 | 0.8 | 0.8570 | 0.3873 |
| upstream E | 1.9 | 0.6 | 3.2 | 0.3 | 0.0594 | 0.0646 |
| ESR1 methylation-- highest quartile | | | | | | |
| | PR negative (n = 7) adjusted mean | sem | PR positive (n = 12) adjusted mean | sem | t-test p-value | p-value* |
| Ex 1-2 | 3.0 | 2.2 | 13.4 | 1.7 | 0.0017 | 0.0013 |
| upstream A | 8.1 | 18.7 | 75.1 | 14.5 | 0.0117 | 0.0007 |
| upstream B | 2.0 | 3.8 | 12.8 | 3.0 | 0.0391 | 0.0061 |
| upstream C | 3.2 | 7.6 | 21.3 | 5.9 | 0.0770 | 0.0105 |
| upstream D | 0.4 | 2.0 | 5.4 | 1.6 | 0.0708 | 0.0030 |
| upstream E | 2.1 | 0.8 | 3.5 | 0.6 | 0.1557 | 0.1089 |

*using rank of expression values

Example 5

The ESR1, ARH1 and CYP1B1 Markers were Shown to have Utility as Statistically Significant Predictors of Clinical Response to Systemic Hormonal Therapy with Tamoxifen This EXAMPLE shows, according to particular aspects, that among the 35 methylation markers of EXAMPLE 2, three markers (ESR1, ARH1 and CYP1B1) have substantial utility as statistically significant independent (or in various combinations) predictors of clinical response to systemic hormonal therapy with tamoxifen (TABLE 10), and outperformed hormone receptor status as a predictor of response to tamoxifen therapy. Two of the three genes (ESR1 and CYP1B1) are known to be intimately involved in the function and metabolism of estradiol. This lends credence to the biological relevance of DNA methylation changes in breast tumors. The third gene (ARH1) encodes a RAS-related small G-protein known to inhibit breast cancer cell growth (Luo, et al., *Oncogene,* 22:2897-2909, 2003).

Hormone therapy with the antiestrogen tamoxifen is frequently used as an adjuvant treatment in breast cancer. HR status has been shown to predict response to tamoxifen treatment (Anonymous, *Lancet,* 351:1451-1467, 1998, Bardou, et al., *J Clin Oncol,* 21:1973-1979, 2003). The patients of the instant analyses showed a similar trend using a proportional hazards model to test whether the association between hormone receptor status and survival differed by treatment with tamoxifen therapy (mean follow-up 5.2 years). However, the interaction (see interaction P-value) with treatment response was not statistically significant (TABLE 9, herein below).

TABLE 9

Prediction of Response to Antiestrogen Therapy with Tamoxifen

| | TAM | | Not TAM | | |
|---|---|---|---|---|---|
| | Hazard Ratio[a] | 95% CI | Hazard Ratio[a] | 95% CI | Interaction P-value |
| Survival | | | | | |
| HR | 0.7 | 0.3-1.8 | 1.0 | 0.4-2.7 | 0.54 |
| ER | 0.8 | 0.3-2.1 | 0.9 | 0.3-2.4 | 0.87 |
| PR | 0.5 | 0.2-1.1 | 1.1 | 0.4-2.8 | 0.22 |
| Disease-free survival | | | | | |
| HR | 0.6 | 0.2-1.3 | 1.1 | 0.4-2.7 | 0.31 |
| ER | 0.7 | 0.3-1.6 | 0.8 | 0.3-2.2 | 0.71 |
| PR | 0.4 | 0.2-0.9 | 0.9 | 0.4-2.3 | 0.19 |

TABLE 10

Prediction of Response to Antiestrogen Therapy with Tamoxifen

| | TAM | | Not TAM | | |
|---|---|---|---|---|---|
| | Hazard Ratio[b] | 95% CI | Hazard Ratio[a] | 95% CI | Interaction P-value |
| Survival | | | | | |
| ESR1 | 0.7 | 0.5-1.0 | 1.5 | 1.0-2.4 | 0.0073 |
| ARHI | 1.2 | 0.9-1.7 | 0.6 | 0.3-0.9 | 0.0103 |
| CYP1B1 | 0.7 | 0.5-1.0 | 1.5 | 1.1-2.2 | 0.0046 |
| Disease-free survival | | | | | |
| ESR1 | 0.7 | 0.5-1.0 | 1.5 | 0.9-2.3 | 0.0134 |
| ARHI | 1.2 | 0.9-1.6 | 0.5 | 0.3-0.8 | 0.0015 |
| CYP1B1 | 0.8 | 0.6-1.1 | 1.5 | 1.1-2.1 | 0.0081 |

TABLE 9 shows a Cox regression used herein to analyze the association between hormone receptor status and overall survival, or disease-free survival in patients treated with tamoxifen ("TAM") or not treated with tamoxifen ("Not TAM"); [a] adjusted for age, stage (I, II, III/IV) and nodes (0, 1-3, >3). Age and stage are coded as continuous variables. The interaction (see interaction P-value) of survival with treatment response was not statistically significant (TABLE 9).

Significantly, however, the novel results described herein indicate a link between hormone receptor status and cellular DNA methylation profiles in breast cancer cells. Therefore, the possibility that any of the 35 DNA methylation markers (of EXAMPLE 2 herein) would be better predictors of response to tamoxifen treatment than hormone receptor status was investigated. The 35 DNA methylation markers were ranked according to their ability to predict response to tamoxifen therapy as measured by a test for interaction in an art-recognized Cox model with adjustments for treatment-specific effects of hormone receptor status. The model was also adjusted for age, stage and number of positive nodes.

Three markers (ESR1, ARHI and CYP1B1) were found to be statistically significant predictors of response to tamoxifen therapy (TABLE 10, herein above).

TABLE 10 shows a Cox regression used herein to analyze the association between DNA methylation PMR values and overall survival, or disease-free survival; [b] covariates include: age, stage (I, II, III/V), nodes (0, 1-3, >3), hormone-receptor (HR) status among Tamoxifen-treated (1: HR-positive and TAM-treated, 0: otherwise), and hormone-receptor status among not Tamoxifen treated (1: HR-positive and not TAM-treated, 0: otherwise). Age and stage are coded as continuous variables.

Applicants' data herein indicates that ESR1 methylation is a good predictor of PR status. Significantly, however, as further taught and disclosed herein, ESR1 methylation outperforms PR status as a predictor of response to tamoxifen (TABLE 10). The relationship between ESR1 methylation and tamoxifen response was further analyzed by comparing the survival curves of patients with above or below median ESR1 methylation levels, either receiving tamoxifen therapy or not (FIG. 3).

Figure 3:
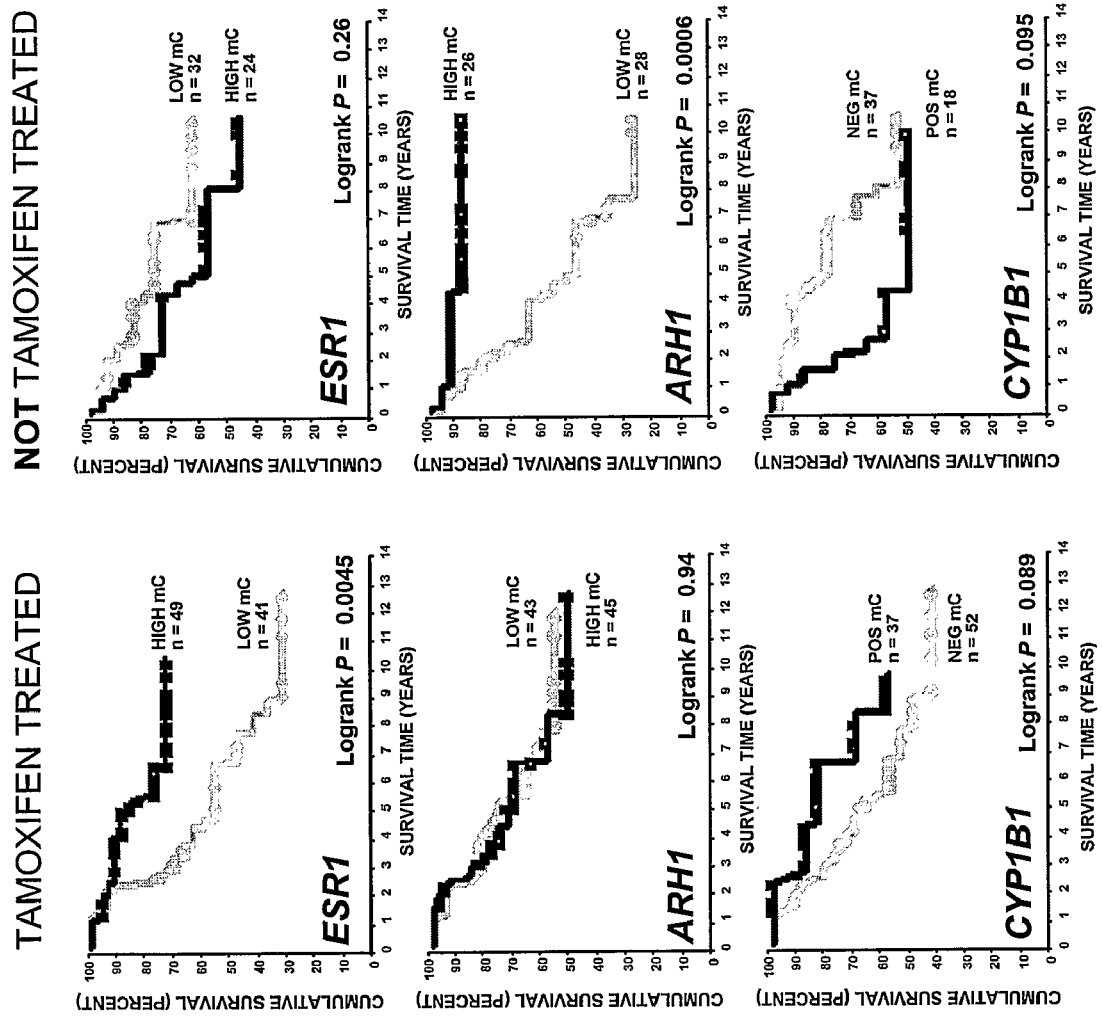
FIG. 3 shows, according to exemplary aspects, Kaplan Meier survival curves for the three genes that were statistically significant predictors of response to tamoxifen therapy in a Cox proportional hazards interaction model (see TABLE 2 herein below). Three markers (ESR1, ARH1 and CYP1B1) were statistically significant predictors of response to tamoxifen therapy (TABLE 2B), and outperformed hormone receptor status as a predictor of response to tamoxifen therapy.

Specifically, FIG. 3 shows, according to particular aspects, Kaplan Meier survival curves for the three genes (ESR1, ARHI and CYP1B1) that were statistically significant predictors of response to tamoxifen therapy in a Cox proportional hazards interaction model (see TABLE 10). Above median methylation levels are indicated by "HIGH mC" for ESR1 and ARHI, whereas below median methylation levels are indicated by "LOW mC" for these two genes. For CYP1B1 methylation, "POS mC" refers to any detectable methylation, whereas "NEG mC" refers to a lack of detectable methylation. The high or positive methylation survival curves are shown in red (dark grey), with squares indicating censored events. The low, or negative methylation survival curves are shown in green (light grey), with circles indicating censored events.

High ESR1 methylation was a significant predictor of better survival in the tamoxifen treated group, but showed no significant predictive value for the non-tamoxifen treated group (FIG. 3). ESR1 encodes the estrogen receptor alpha. Patients treated with Tamoxifen and who had high levels of tumor ESR1 methylation showed better survival than tamoxifen-treated patients with low levels of ESR1 methylation. The survival benefit in patients with high levels of ESR1 methylation may be due, in part, to the positive association between ESR1 methylation and PR status (TABLE 5, column C). PR status appears to be a better predictor of response to tamoxifen than ER status (TABLE 9).

ARHI promoter methylation was a highly significant predictor of survival in patients who had not received tamoxifen therapy, while showing no predictive value for tamoxifen therapy (TABLE 10 and FIG. 3). Patients with high levels of ARHI methylation had better survival than patients with low levels of ARHI methylation. However, this effect was completely obliterated in the tamoxifen treated group (FIG. 3). This may be due to the ability of antiestrogens such as tamoxifen to block growth factor-induced mitogenesis, possibly involving pathways regulated by ARHI (Luo, et al., *Oncogene*, 22:2897-2909, 2003, Clarke, et al., *Pharmacol Rev*, 53:25-71, 2001).

Finally, CYP1B1 methylation was a highly significant predictor of tamoxifen response in the interaction model (TABLE 10). The survival curves reveal that this is due to a differential predictive behavior of this marker in tamoxifen-treated, versus non-treated patients (FIG. 3). CYP1B1 encodes cytochrome P450 1B1, which catalyzes the conversion of 17-beta-estradiol (E2) to the catechol estrogen metabolites 2-OH-E2 and 4-OH-E2. The 2-hydroxylated form of estradiol has been shown to have weak ER agonist or antagonist properties (Gupta, et al., *J Steroid Biochem Mol Biol*, 67:413-419, 1998). CYP1B1 is also the principal catalyst of 4-hydroxytamoxifen trans-cis isomerization, which converts the primary potent anti-estrogen trans-4-hydroxytamoxifen to the weak estrogen agonist cis-4-hydroxytamoxifen (Crewe, et al., *Drug Metab Dispos*, 30:869-874, 2002). Applicants have not investigated gene expression levels of CYP1B1 as a function of CYP1B1 methylation, and the levels of methylation measured herein are quite low (TABLE 4 (Data Supplement 4)). Nevertheless, if patients with positive CYP1B1 methylation do indeed have reduced CYP1B1 expression, then these patients would be expected to have lower rates of 4-hydroxytamoxifen trans-cis isomerization, and would thus retain higher levels of active anti-estrogen. This would be consistent with the better survival of these patients among the group treated with tamoxifen (FIG. 3).

Conversely, in the patients that did not receive tamoxifen therapy, patients with tumor CYP1B1 methylation would have a reduced capacity for conversion of estradiol to its weaker catechol derivatives. This would be consistent with the observation that these patients show a worse survival among the group not receiving tamoxifen therapy (FIG. 3).

Collectively, the instant results show that DNA methylation markers can outperform hormone receptor status as predictors of response to tamoxifen therapy and indicate that DNA methylation markers have clinical utility in directing hormone therapy in breast cancer patients.

The teachings and data presented in the present EXAMPLES, show that DNA methylation markers have substantial and novel utility in classifying breast cancer tumors, hormone receptor status, and in predicting response to hormonal therapy.

In EXAMPLE 2, MethyLight™ analyses, using 35 informative DNA methylation markers, was performed on 148 primary breast carcinomas. The unsupervised clustering analyses revealed two major tumor clusters, based on distinct methylation profiles, that also differed significantly in their hormone receptor (HR) status.

In EXAMPLE 3, the 35 DNA methylation markers of EXAMPLE 2 were ranked according to the strength of their association with hormone receptor status (HR, ER, and PR). Three markers (SOCS1, RASSF1A and BCL2) were significantly associated with (the best predictors of) HR status (TABLE 5, column "A"), whereas neither ESR1 nor PGR methylation markers were good predictors of overall HR status, but were each the best predictor of the status of the other receptor, but not of their own cognate receptor (TABLE 5).

EXAMPLE 4 showed, according to particular aspects, that there was no clear inverse relationship between ESR1 expression levels and quartiled ESR1 methylation levels when the tumors were analyzed collectively (FIG. 2, left panel). However, PR− tumors showed a statistically significant inverse trend between ESR1 gene expression levels and ESR1 methylation levels (FIG. 2, rightmost panel).

EXAMPLE 5 showed, according to particular aspects, that among the 35 methylation markers of EXAMPLE 2, three markers (ESR1, ARH1 and CYP1B1) have utility as statistically significant independent (or in various combinations) predictors of clinical response to systemic hormonal therapy with tamoxifen (TABLE 10), and outperformed hormone receptor status as a predictor of response to tamoxifen therapy.

SEQUENCE LISTING (183 sequences)

SEQ ID NO: 1 - DNA, 7242 bp, Homo sapiens
  misc_feature (137)..(137): n is a, c, g, or t
  misc_feature (169)..(169): n is a, c, g, or t
  misc_feature (216)..(216): n is a, c, g, or t
  misc_feature (218)..(218): n is a, c, g, or t
  misc_feature (1165)..(1165): n is a, c, g, or t
  misc_feature (1237)..(1237): n is a, c, g, or t
  misc_feature (1953)..(2038): Amplicon location
  misc_feature (2215)..(2215): n is a, c, g, or t
  misc_feature (2431)..(2431): n is a, c, g, or t
  misc_feature (2735)..(2735): n is a, c, g, or t
  misc_feature (2741)..(2741): n is a, c, g, or t
  misc_feature (2982)..(2982): n is a, c, g, or t
  misc_feature (2991)..(2991): n is a, c, g, or t
  misc_feature (2997)..(2997): n is a, c, g, or t
  misc_feature (3047)..(3047): n is a, c, g, or t
  misc_feature (3090)..(3090): n is a, c, g, or t
  misc_feature (3579)..(3579): n is a, c, g, or t
  misc_feature (3584)..(3584): n is a, c, g, or t
  misc_feature (3731)..(3731): n is a, c, g, or t
  misc_feature (3772)..(3772): n is a, c, g, or t
  misc_feature (3834)..(3834): n is a, c, g, or t
  misc_feature (3909)..(3909): n is a, c, g, or t
  misc_feature (4037)..(4037): n is a, c, g, or t
  misc_feature (4039)..(4039): n is a, c, g, or t
  misc_feature (4043)..(4043): n is a, c, g, or t
  misc_feature (4066)..(4066): n is a, c, g, or t
  misc_feature (4164)..(4164): n is a, c, g, or t
  misc_feature (4200)..(4200): n is a, c, g, or t
  misc_feature (4230)..(4230): n is a, c, g, or t
  misc_feature (4382)..(4382): n is a, c, g, or t
  misc_feature (4385)..(4385): n is a, c, g, or t
  misc_feature (4428)..(4428): n is a, c, g, or t
  misc_feature (4458)..(4458): n is a, c, g, or t
  misc_feature (4470)..(4470): n is a, c, g, or t
  misc_feature (4503)..(4503): n is a, c, g, or t
  misc_feature (4581)..(4581): n is a, c, g, or t
  misc_feature (4791)..(4791): n is a, c, g, or t
  misc_feature (4800)..(4800): n is a, c, g, or t
  misc_feature (4875)..(4875): n is a, c, g, or t
  misc_feature (4902)..(4902): n is a, c, g, or t
  misc_feature (4915)..(4915): n is a, c, g, or t
  misc_feature (5111)..(5111): n is a, c, g, or t
  misc_feature (5167)..(5167): n is a, c, g, or t
  misc_feature (5260)..(5260): n is a, c, g, or t
  misc_feature (5309)..(5309): n is a, c, g, or t
  misc_feature (6753)..(6753): n is a, c, g, or t
  misc_feature (6768)..(6768): n is a, c, g, or t
  misc_feature (6912)..(6912): n is a, c, g, or t
  misc_feature (6996)..(6996): n is a, c, g, or t
  misc_feature (7110)..(7110): n is a, c, g, or t
  misc_feature (7199)..(7199): n is a, c, g, or t
  misc_feature (7229)..(7229): n is a, c, g, or t
caggcaaaaacatcagtcaatatatgtaaggtatacattggtttgacctggaaagccggtacattttggaggaggaggggtttggccagtggtggcaggagggaggttgtggaagccagggttcttgttacatatgngaagcctgtaatatgcttcagaaagaataganggcatatgtacctcaaaaggtaaatgaccttaaacggtgtcagactntnagttaaatctctcccggatcagagaaagacctggaaagggaaggagattgtccacagaacacaaatttccctcgcaaaagatagcattgcacaggaccattccaaaatatgtcagaaatatattttggggtaaaatactttgatcgcccttagggctgctacctgtcatgtgatgctataccagaatcaggttggaatttgttttgagacaggttctcactttgttgctcagattggagtacagtggctgtgatcacggctcactgcagcctcgatctccttgatgtgggaggctcaagtgatcctcccacatcagcctcccaaatagctgggactacaggcggccaccaccacactgggctaaatttttttaaagtagagacaagttctccccatgttgcccaggctggtctctaactcctggcctcaacctccttattctctaggattacaggcgccaggctagacctcacaggtctttagacttctacgcaccaggtacctggtagggggagggattatagtggcagaagagcagtaccagtggcccacaccacacaccctggcctcagctggctggggcacacaaaaccaggtgctaccgtcaacgactaggcccatagggtactgctgtcaaaacctgctgccaacaacttccacacactccccaaaacgctcggtaggcggtggtgcgcagctttcaatgcatccgccgccaggcgctcacaggcaagggagaaagaagccagacggagctcggagatgtggagggcagacgcaggcgcatttggaaaagggactggcggtgggaggcgcagagggaaaaaggaacgacacaatcgggcttcctaaccgctggcggacccgatggggcgtcctgcgagggttcggcgagggttctgccaggatagtagcattgcgcccaaggagtgagaggcacccggggntactggagccagaccctcaacccgccctagtgggaggcgaagaacaacgaaagcctcgtattcccatttctntaatggctaatgacattaaaggttttcatatggttatttgccatctgcatatcttcagtgaaatgtctgtttatgtcttctgactattctctaattggatttttaaaaataattgatttttgagttatttacatattctagatactggttgtatgccagatatatggcttgtaaatattttctcctaggtaaaccttttcagtatcgttacagggtctttcacaaagcaaaagttttaaatttatggagtctaattcatcaacatttctttttaccggtcttgccactaatgtcaatttaagaaccttttgcctagccttagacaatagtttgttgttttttaaaaccgttttgtaattttactcgtcacagttatatctagccacttaatttttatgtaagggttatttttggcgggggggaatctatagatgtcctgtcttttcagtatcatttgtggaaaagattatctgtcctgcattaaactgcttttggactttcgtctaaaatcagttggaccggtttttgttggcaaagttttgcctgaagcttattccaacaggtgagaaaaagtccacagtttaacagttcctccccaacctgtaaccccgccttgaacttctggactagcccctcgattgttgtagatgccaagcggacctcgcgccgctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggtaagtctttctttcgcttttttaggggtacttgaaaacaacaagtgtcagacaaagcagcagatgctgttgcgcagtanaagtttatgggcgagttgtccctgaaactggaaccaggtctttcttggcgcgattacgcaagaaccacccgcagccctgcgggctcctggcaggtcctgcaactgcactttggatagtcccgttgggaagctagcactttttaatataaaagaacgaggtttgataagtgtgcgagcttaaaggttgacacagtgtccactattacagctgcgtangtagctagtgttcaggaagtaatagtggagtcatgtagtgtgaaagtaagattgaaatgggcgaggagggtagcagccgccacagccaccagagagaaacctgaccttgcaggtgcgtggtgatgtccatgagccaggctggtgccgcaacagcagcggcgggaccttgagctccgcacggccgctgggtttggacgccctctggttcctggaaactttcacctccccctcagcctgaggccaggtggcctgggaaggtggaacgagtgtggaggggagtgggggggggggtccactgcctganaatganaattctcttcacatctggaaattcagttatcacgtgtgtcctttaccaattttttttcttttattttctttttgatagagacggcggtctccctatgttacccaggctagtcttgaactcctgtgcttaagcgatcctcccaccttgacttcccaaagtgctggaattacaggcatgagccaatgcgcccggctgctttaccaattttctatgaatgaatttgtacatacatcccctagancaggaagtnatgtanaacagaataattagtaatgcacatttcctaatgtgggatgttggtggccnacagatatttggtctttactggaactcttgatactaacatggnagtttataatagttgtggagagtgcagacaaggctaggatttctgtgactagagaactcttagtgcgtgaagacctaaggaaagctggattgttgatttttgttaataaataagatgtgaaagattgcatcactgtagcagaaatctcctagttttttaagctaaattctattaaaggtcatcattgctaaaggaattgtgcccaggatttggatagctgatgtcattacttaatattagatgatatcaactaaccacatctcatagactggaataaagtgctagattttacctgaaagctgcaaaaatgaatggtttagatatatgtatgtatttattttatatcaatttcaaatatttactgtattaacctccctggccccctttaatcaagaatataaaatcatctacttaaattttgccacttaagtttagaacactcttagaatcacactatcttaaagaagccagactagaattagaagcaanttaantctgaagatataacaaccagcaacaacatttttttttttcaaatgaaaactctaatatggggtgggtatgttgtgtcacacctgtaatcccaacactttgggaggctgatgcaggaggatcacttgaacacaggagttcaagaccancctggacaacatagcaaaaccctgtccctacaaaaaataanaaaattagctgggcatggtgtcacatgcctgtagtcccagctactcgggaggctgaggtganaggattgattgatcccaggaggttgaggctgcagtgagtcatgatcgcatgactgcactccaacctgagggacanagcaagaccctgactcaaaaaaaaaaaacaaaaaaaaaaaaaccaccaccaaaactctaatatggacatattactctctcatgggacttgcacattctaaaaagggtccttttccccagtactggganantatntgttcaactacgcagccagcaanacaggctattttatatagggagtgtgctattcacaaaaagcctctcttctctttctggtattgtacatgacacaatcatagctgtacctgaaaaaaantgcattttaaggaccatcatcacctaaaaacatgtntaaatttctatacctagtgccacaggaatnacattgccttgtactattcctacctctgtccaaaggccagctatgtggtctgtctgcatggtgcctaaaactttttccatctgacctaggatgcttctgaagcagtccccctgggcagctgtctggtatttaggatatacctgtgagaaaanttncttacaaccctaatctactatgtttattcctgaactcaaaaanttcatttgactgttcaattcctgaaatttnctctatttccanaaggctgaattaaaattactttgttaaaggtantagccatggcaaaaaaaaaaccactgttctgtaaaaaaactcattcaatatttacaatcttttctaatcaaaaattanatcctgaaaagaaaggttcatatatatatatatatatatatatatatatatatatatatatatatatatatatcttttttttttttttttttttttttttttttactccactgtcattgtgactaaggattcatgaactaagacccctccctcagcttttggtggcacatggtgacagcatgctcagagcaaaggtgctccccatgcctnttctggggntgcactgactgcaggtacctcccctttttacatcccacaccagtgaatccaaaaaccccctcctttctcctgtantgatgactctgtagctttaaccagggngacggtgtcactntaaatgtcaccttggcattcagccccatagagtggggaaaattccctcacctgtttctctttgactgttcagtccacttcaattaaaatcttaattttacaagcgaggaaatgagagtgtttcttgtaggggtgtagtgagaatttaataaaacagtttaaggaaagaaaacaaaaggtagtattgctgcactttntagatggtaaaaagcaaaccaccatgtctgtttaatatatatcacctgctggtccntcggtctagcaggctgaactgtgtgcctgggaatttttttctcgctgtgtgcacccctttacgtcacagggtggatctcttcagagtccatgnggagcagctggccaggctgacatgatctgacaagattgtaggttaccantaccatctctcaccgtctcactttcttcctaggggtctcctgctgccagctaagtgtgggagaacttgtgcacgtatctcccctccgaatcccaacgatgggtaacgccagctttggctccaaggaacagaagctgctgaagcggttgcggcttctgcccgccctgcttatcctccgcgccttcaagccccacaggaagatcagagattaccgcgtcgtggtagtcggcaccgctggtgtggggaaaagtacgctgctgcacaagtgggcgagcggcaacttccgtcatgagtacctgccgaccattgaaaatacctactgccagttgctgggctgcagccacggtgtgctttccctgcacatcaccgacagcaagagtggcgacggcaaccgcgctctgcagcgccacgttatagcccggggccacgccttcgtcctggtctactcagtcaccaagaaggaaaccctggaagagctgaaggccttctatgagctgatctgcaagatcaaaggtaacaacctgcataagttccccatcgtgctggtgggcaataaaagtgatgacacccaccgggaggtggccctgaatgatggtgccacctgtgcgatggagtggaattgcgccttcatggagatttcagccaagaccgatgtgaatgtgcaggagctgttccacatgctgctgaattacaagaaaaagcccaccaccggcctccaggagcccgagaagaaatcccagatgcccaacaccactgagaagctgcttgacaagtgcataatcatgtgagccctgggccttaagagccagctcttcctatcctgtagcgtgtagaaaacgtggactcatttcactatgttacatgtacatggttgattttgtgctgttgtttggactgtaacatccatgttgtcaatacgtataccttgtaagtggataacttttctttttcccaggccagagaattcaaattgttaaaacattggcatttgaagaggagaacaaaatgtagcatgatgtatttaaagtaaggcctttagtaatgaatgtaatgagagaaaatgttttgaaaagaacaaaacatcaaaatgaatagaaagaaaaattggaaggcgtccttttggtaacccgattattgtgtattacctttaaatatttcacatcctgtaagtgcttaatcatatcttttaattgtgtatttaagaaaagtgttttcacaacaaaagcttttgataaattgctgcgtgacatatactaaataaaaaaatgaatatgttgatcattaggggtgtgggagcagagaaaattgtgaaagtgactctcactaaagatgttagtagtttctcatgtcatttaaaaatgtttgagtattctgcatagcagtttgtaaaagtgtaacagcttattgacttaataaagcttttcctgcatgcaatcagctgtaanaatttgtctcaccanaaaacaaaacattgcccattgtattaaaatttaaaccatatctgttaaaagtttccaataagaacttcacacatggatgtccttgccatgttgaaattatccaatatgggaggggggtgttttagggaggtctctgcaatacanagctgttttgtgtctttcctgaactgacatcccgaaaaactccaggcatctttgaggaaaatggtcacagtgttgctgtctcanaggaagcgggtgaaaagcaagcctctgccttctgcctcttcctatattctgaaatactggatataggcaatagggagcagaatgaaagacaaggggaggaatgatatttgaganactcccccataagggagtttttaaagagattatatttgaacataattttttgagcgagggaataaagtatacatatccttgcttttganagttttttttttttttttaaattgggaaangttcaggggaggc

SEQ ID NO: 2 - DNA, 23 bp, Artificial sequence
  ARH1 Forward Primer
gcgtaagcggaatttatgtttgt

SEQ ID NO: 3 - DNA, 22 bp, Artificial Sequence
  ARH1 reverse primer
ccgcgattttatattccgactt

SEQ ID NO: 4 - DNA, 29 bp, Artificial sequence
  ARH1 probe oligo (6FAM--BHQ-1 format)
cgcacaaaaacgaaatacgaaaacgcaaa

SEQ ID NO: 5 - DNA, 6030 bp, Homo sapiens
  misc_feature (215)..(298): Amplicon location
gttggcccccgttacttttcctctgggaaatatggcgcacgctgggagaacagggtacgataaccgggagatagtgatgaagtacatccattataagctgtcgcagaggggctacgagtgggatgcgggagatgtgggcgccgcgcccccgggggccgcccccgcgccgggcatcttctcctcgcagcccgggcacacgccccatacagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccaggcagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgttccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgcttttaatataaagcctgttttgtcttctgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaatcaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaacaatttttaaatataaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 6 - DNA, 20 bp, Artificial sequence
  BCL2 forward primer
tcgtatttcgggattcggtc

SEQ ID NO: 7 - DNA, 19 bp, Artificial sequence
  BCL2 reverse primer
aactaaacgcaaaccccgc

SEQ ID NO: 8 - DNA, 28 bp, Artificial sequence
  BCL2 probe oligo (6FAM--BHQ-1 format)
acgacgccgaaaacaaccgaaatctaca

SEQ ID NO: 9 - DNA, 12177 bp, Homo sapiens
  misc_feature (2905)..(2990): Amplicon location
gagctcaattaaccctcactaaagggagtcgactcgatctaaaaactagatggcattattgaggagttggacaggcggtcttaggaacaacctcgttttatactttttaaaaataggaatttacttaaaggcaacttccatctgctctcattctggcagaggtattgtgataaaggctttcaggaatgtcaacagctcaggattggcattagctcatagataattcccgtctactaaattaaagtctatgagagattgatgcatgcaccagagtcttgaattattaggcaaggatcttgctaaagctggacatgggaaggttgctatgaaactcatttcaaaggctgtgtaggccaactcacctctgggaaaccaacgcttattattaaaccaatgcaactgctcaaaaactaaaactccatcactatctaagttccccatcatggtgtgtgaaatcatttccagaaaactcttcaaaagataccgaataaaaggcatcacaggccgggcacggtggctcatgcctgtaatcccagcactttgggaggcccaggctggtggatcacctgaggtcaggagtttgagaccagcctggccagcatggtgaaaccccatctctactagaaaaatacaaaaattagccgggtgtggtggtgcgcacctgtaatcccagctacttgggaggctgagccaggagaacctggcaggcggaggttgcagtgagccgagatcacgccattgcactgcagcccaggtgacagagtgagactccatctcaaaaaaaataaataaataaaaataaaaataaaaaaagccatcacgaaaagacatttctttatcaggtcagcaaattgattgctggtttcaatctctcaagaagtcagattctcttcagacactcctttgtgtttctttacaatgtaatcagtcattccagggtcagctatgaggcacactcccctggcctccctcataagcaatttaattgcaaagggttagcatactatttcttctctgctattctcagaattctcaattatgaaaacaaaaacaataattaaaaagttcttccagctgatttttttttttttttttgagacagagtctcacttaaactctgctgcccaggctgtagtgcagtggtgcaatctctgctcactgcaacctctgcctcccacgttcaaccaattctgctgccttcccccctgatccccgagtagctgggattacaggtgtgcaccaccacgtccggctaacttttgtatttttagtagatggggtttcgccatgttggccaggctggtctcgaactcctgacctcaagtgatccgcccgcttaagcctcccaaagtgctgggattacaggcgtgagccactgcgcctagccccacgtgcatttttttttttttaagggaggcaggaaagaaggcatttgggcctcttatctgcaattttcttccgtgtaaacttatgtgaaggatctggagtgggacttggtggcttcaagccctggctccacttcttgatggctgcgcgacctgggttaagtcacgcaacctctctgaaccctagtttattcatctgtaaacaggtcaataatagcacgagattgcagcgcgagtggagctcaaagtgcagggttgtccctggtgaacctatcacttttatatttatcctttgatgaagccagtacaattcctacctggttaaccagatacatcccacctcttccctcgagttcgcccttccccccgcctcgtgaagtccttgttctcttagctgtcttgaaaatcctatgcatcagcatgtaggaaagggcgcgccaggcgggggaagccacccccgcccgagcgcctccggttcccttataaagggagggcccccttcgcgaccgcaagcgcgcccaggaagaccacagagccgccggtgcgcacggaggtggcgatacgcgcccgggctcggcctgcgggtggtggcccaagcgtccgcctcgctggcctggcaggcgcgactgtgcgtgcgcagccgagggtggtggcggccggcaccccacgccaagggtggtggtggccggcaccccaccctcggccgccgcctccgcgtgtcaggtgccgtgagaagcgcgggaggagcggccgcaggcagcgcccagggatatgactggagccgactttccagaagcggcgcacgcaaagcccagctccgcacgcaaaggggaggcgacacgagaaacttcaacccgataaagttcgccggagcgcggagattcgcctcctcctgccactctccgccccgctcgggtcccgccccgctagctcccccaggcccccccagtcgccccagcttggctccccgccctgcgccaacggcttccatcgcagcctgggcggccccgcgcccaccagcgggcggcgccacctggagtggcctctacgcgggaaatctcagggccagctgcgccccaggagcctttgtgtgcccaagcactgtcggggccccggggcgggggagcggctacttttagggattcctgatctcgccgcaagaactggaaaaaatttagcatgccaaagagcctccactgaggtggcaatttgtttgcgagaacctaagataaaatttaaacaaccaaccaggggcgctgtgaggcaaaccgctgccactacactggctttccgggaagcaagctcaagccgcggagagggaagggaggtcgtgcgctcggggcggggcgcgctcccaagtcgagcgcagcggccggggcaggttgtaccgagcgtggttctggggacaccgtgcggccttgattggaggtggctgtgatgaagcgcggttaccgcacaatggaaacgtgggcacctccgctcccatgaaagcctgctggtagagctccgaggccggccggtgcgcctggacgggagtccgggtcaaagcggcctggtgtgcggcgcgccccgccccccgcaggccccgccctgccaggtcgcgctgccctccttctacccagtccttaaaacccggaggagcgggatggcgcgctttgactctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcaggtcagtctgtctgccgaggcgctgcccggcgacctcttcagatggattattacaggtagcgggtggcgtggtaggtactttaaaggaaatcaagcgccaccgcctcgatgcccgcagcgttgtccccaaattgcaggaaccgttacgcgccttgcggggaggggaagggtttggcgctgggttacagcgaggtggaaacacgccccttctcttctccaagggagagtgggttggggatgggaaggggcgtcttcggccatttctccagagagtcagctccgacctctccacccaacggcactcagtccccagaggctggggtaggggcgtggggcgcccgctcctgtctctgcacccctgagtgtcacgccttctcctttctgtccccagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtaaagcctctgggaggcgtgggccaggtcttttctcctctgaaaaaggcggagtagagacagaatatgctgagtttgcaagcagggccccgggtttggggtttcgctccaggtccccacccctcaaaaccaagatcgcgtcggtaaagggactcacagtgagggctgcgacacgcacgcgccccacccagcggtgccccgacccctccggtctcctatcttgtctctatcgtcccctcccctgcttgcgagtgagaacacatttgcaaagacccctccaccccccgggaaaaacaagagtttttaaatgcttggagatgagccctgatatctctctccctggcgcattacaatcagaactggaatagttccgaaagaaaaggtaatgtcataaatatgttaaacacagcagcctctcctaggctagtcctcggcgtgcatccgaggccgcccagccctggcgctaaaagcgggccgcccgtcagggctttgttccaggccaaggaagcccatggaggccgggccagccgacaggtaacccgcacagaaactttcagaaggcggccacaactagcgggcagcgctaggtttataaaacctccgcgctaggagtttgagaaatgccggggtagaagacaagaagcagtcacttttacgaaagcagagtagcattcagaaaggcagatgggatatccaggaggcgcctgcagacgtttctggcccctgcgcttggctcagttagcggaccccctgatgcccacgttggtctctactaagcacggattcaacaggtccctggtgtcgggttgccagatttggcaaaagaaaagtaagttttacacgggaatactcacactaaaagattagcccttgttgatctgaaatccatatttaactgggcggcctgtagtatttactgtggaaacactatccctaggggcaaatgtttcgcaaggcaaattttgattgccgaagagaccagaaatcctggttttgtgtcatttcttggagcacaagtgagcagttggagatgctgaatctgcaggcgccacagaaaggtgtttggaaggcagagaatgactctttccttattaaaatccactgcaatctatatttccttagatactgtacagctaccttcacaaattaaaagtttctgtatacttaaaatggctttttagtattaaaatcatagaaacacccatggtgggtgagggagaggcagaaatcgaataaagaaaagtcaaccagagatcagggaaaaggaaatcccggaataggttccataggtttttgtgcatccgcagataggcattttaacttttgaaacggcctttgtttttcattagaaccacaatagttctccgagtactccaattaggcggcaaaaagaaataaaacaatttggaggtcactttcaattcaatatgctgatacttttttttcctttttagtgaaaagacgtatgacagggcttggcaaattacacgatctgtttttgtatatacgttttattgacgcagtcatgcccattcatttatacattgtcgatggctgcgttcactctacaacacaaggcagagcagagtagtgcaacaaagagggtttggtccacaaagtctaaaatagatactctctggctctccccaccatacatgtttctatgaaaaaagttggcagactcctgcaatataatgttgaagaagcgattctaaaaataactccacttcatcacatacgtgtatacattttttttcggagttgcaaacaatcagttacttgttttttgacttctaacactttgactcaaggtagtggacatttctaatcttttaatatttattttggtaatttttgatggctatatagtattttgctatgataatgtatagttatatataatcatttattgaactttaatgttggtcattggccttgattgcatttttaaaatttttattttaattttatgtatttacttaccttagagacagggtctcactaccttacccaggctggtcccaaactcctgggctcaagcagttctcccgccgctgtctggcaggtagctggggctacaggcgtgtaccaccatgcctggctaatttttagaattttaggtcctgttgtggttacatatttttgtatctcttaaattattttctgaaaatacatttctaggcatggattactgggtttaaaatgaggcgggaagaggttaccttcatgtctcttgcctcgtattaagattttgttttttaaaaagattgtatcagtttgtatcatcaacagtgaataagtactacagtttgtaccataattttatgaacattgggtatttgctttcaaatttaaaaaatacagtatgtagctttatccatcaggacaccaattatctttgtataaaatgagaacagcatgtctgttggaattgtccagggaaatgagggagaaaaaaaatttactttcacattgtaactttcgtgggccctgggtgcttttgcctttgtagattccttatactataaaaaaattaaaaattaaatttcatgactaccctgatataaagatgaatgcattaaaatgatgtatgaaaatattttcttctacctaaaagtgagtttttttaggtctgaagattgtaaaagacgtaaaaatattttcatgggcccctaaaaagtgttgtgagccctaggcactgtcctgcggtacccaatggaaaagtcagccttatctactattgtgctttttgaggctgggaaaacttaagagttttttgacttataatgggaaagacagcattagtcatgcaaggcctattacaggaaatataattcttaaagtccatcttgtaatttagtgagaaattaggaagctgttttagatttttttcccagaaatattaatttagtcactgagctagatagcctatttaagaaaaagtggaattaaaataaattataatgtgctttctagatgaaataagaattttgctcacttgcttttctctctccacattaaacaccaaacaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccactgaagtggcctaacccggagaactttgatccagctcgattcttggacaaggacggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgatttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaagaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgttatgaagttttatgttgtagcaaatatagtctaatgtatcactttatttcaactattactatggattattcaattaaaatattgcactgtaaacattttatttgtccattctacatttcaggccgaggccacatgcttttttttcccgtaggttttcatcaaccaaatttctaatctctatatttttgaatttctaagaaccaacacggaggttacatttcaatcaaacaatcaagccaaatgagaattaatttgcaatgttgaaagattgaatagattgcgactttaagttgctgatcgatttctgcttcatctaaagaatgcagtacacatttttcttcctcagcctcataccagtcctttctctgagtattttcttctttcatttttttaaaggtacatgtgcctcaattagtgcaattaatgtccaataaaataagatgggtacaagtattctgtcatgtactatgtggaaatgttttattgccaatctttttacttggtaaaaatacttgacttcacagggcctaggtcatgactctccaggccttcactgtgccacactcacagatgacagggcttgcggtac

SEQ ID NO: 10 - DNA, 19 bp, Artificial sequence
  CYP1B1 forward primer
gtgcgtttggacgggagtt

SEQ ID NO: 11 - DNA, 21 bp, Artificial sequence
  CYP1B1 reverse primer
aacgcgacctaacaaaacgaa

SEQ ID NO: 12 - DNA, 20 bp, Artificial sequence
  CYP1B1 probe oligo (6FAM--BHQ-1 format)
cgccgcacaccaaaccgctt

SEQ ID NO: 13 - DNA, 3350 bp, Homo sapiens
  misc_feature (2784)..(2884): Amplicon location
ggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtgaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccatcgcacatgcgagcacattccttccttccttctcactctctcggcccttgacttctacaagcccatggaacatttctggaaagacgttcttgatccagcagggtaggcttgttttgatttctctctctgtagctttagcattttgagaaagcaacttacctttctggctagtgtctgtatcctagcagggagatgaggattgctgttctccatgggggtatgtgtgtgtctcctttttctttcaggacttgtaggattctttgtgccatttgcatataatttggcaggttcacattttttaagagccctatgaagtgctttttgcatgtgttttaaaaaggcatttgaaaattgaaagtgtgatttatggaaattaaatcatctgtaaaaaattgctttggaaagtaatgattgctggccataaagggaaatatctgcgatgcacctaatgtgtttttaaccctttatttgctgacaatctatagtcattaatgctaaactcgattttggcttcagctacatttgcatattgtccaacaatggtctatttttgtaagaattagataaaatgtatacttgatataaaatagtcaaaaatgtaactcttagtaacagtaagcttggcatttagatagaccatgaaccacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatgctcaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgca

SEQ ID NO: 14 - DNA, 19 bp, Artificial sequence
  ESR1 forward primer
ggcgttcgttttgggattg

SEQ ID NO: 15 - DNA, 19 bp, Artificial sequence
  ESR1 reverse primer
gccgacacgcgaactctaa

SEQ ID NO: 16 - DNA, 24 bp, Artificial sequence
  ESR1 probe oligo (6FAM--TAMRA format)
cgataaaaccgaacgacccgacga

SEQ ID NO: 17 - DNA, 5003 bp, Homo sapiens
  misc_feature (811)..(904): Amplicon location
ggatccattttataagctcaaagataattacttttcagactaagaatatttagggtaaaaagtactgttcaacatctctactgaggatgttatgatgtagcacactctataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgcgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatcctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatagctctgagtccgaggagtctgcgggtccgcttctgaagggcaaacctcgggctctgggtggcgcggcggctggaggaggagccgcggcttgtccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggacttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccattgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacatgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacagcttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggcatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatacaaatagtattgtgggttttgtaggtttttaaaataaccttttttggggagagaattgtcctctaatgaggtattgcgagtggc

SEQ ID NO: 18 - DNA, 25 bp, artificial sequence
  PGR forward primer
ttataattcgaggcggttagtgttt

SEQ ID NO: 19 - DNA, 28 bp, artificial sequence
  PGR reverse primer
tcgaacttctactaactccgtactacga

SEQ ID NO: 20 - DNA, 34 bp, artificial sequence
  PGR probe oligo (6FAM--TAMRA format)
atcatctccgaaaatctcaaatcccaataatacg

SEQ ID NO: 21 - DNA, 28244 bp, Homo sapiens
  misc_feature (18107)..(18171): Amplicon location
gatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggtactgtgaaattttccaaaatcttgtcaagctaggagcatactggtcgagtcacatgccatctgttgaggtgttcgctgtacataggtggagacctacagtcaggtattggggcacatccggaaagacaaaatcagtctttggccttaaggaactcagcagttaggtgtctggggtccacgaggcacttttctcaccactcgggccacttaataagtctcaagaaatgcagtttcctttggtgctgtgaagtcccagtggagggacacagaaccctggccttgcctcagaatctcagaatcctagacattgggcctgtgggagccagaagcaacctgctggtactttcccctgtgaggaagggacagggaaggaggcctggggtcctcaaaaggtgatctgggccactccaatttccaaatgctgtgtcctcttcctgggctttaactcagatgctgtgcttctctgccacttacttattgagagggaagcttggggtattaccacatttacctctgtctccagcaagcatgtgtcaccaaaaccagggacaggctacatgacccactgagggagcctgctgacaccagggagtggcgatgaccctttcattatctgtaaaccaagctatccacagcatcaggagtcccagctgaattattcactgaatgcactttggccagggcaggagggatctttttaaattcagcttactctctctcccagatctgtggagccagcagagtggtcccagccttcataagatccacagctccatttccaacattattcctcactgttttgaggcaattactcgagtagtaaaatctgggacgggctttgtcttttgcattgccaaggctcctgcttttgctcacctgtgaatggggttgtggcaggaagctctatgaatttagctgcagttatccctgtatttactctccactgggctatggaattgagtgtgggacacactcctttcttgaaggagttccagctggggaagggccacagatcactatggcccaaggtatggtaggtgttgaaaagtatatacagcatgctgcagggcataattctgggccctagagcttgggtctttataggtgataagccctaaggacagaagtctctcttaaccttagctggtattaaagatggggccaggtgagctgggcctggtaggaattgagctgtccctcagagccattcaggtggggccaggccagtggggacccctcctccactgagaggtgttggaatgttagggttggctggacattcaaaaacctctgcctaggcccaagaaaatggacaggggggaagcaggttggtggggaggaagggagggtcaagaggcgggttcttggcatagccttatggttgttagcttacatgggggtggcggttattcctccagccagtttgacatctgactgcatggccacgcccaactccaaagggctaccaggagagggaggcagggtttcctatctgtctctctggtccttgtgaggaagtgactagcgtaacactagctctctgccttggcaggctttagatggaactggcaagggcatcatcaggatggcagcctgggtagcagcagggaaagactgtcctgtctataccaacttgtcatgtgtgagactgacgggcaggggggaagcgtgctagggctttctacacctgtgcccttgttgcctctcttgtcgtgttccctgacatggtggagattttggttctcagctggaacctgaaaggctacacaggctgtccccacattggtggcacagagaggctgaggtataggagtccacagtggtcactgttgaaacggttccctggcagctgcagcactccaccttctggtgggtcagggtcccaagcacatgtgtaaaccttcttctgttggactttcccacctgccctcaaagtggggcctctaagggtccaccctgtggaagcagtaggctctggcctgtgcctacccatgtgagctgtttctccttcttctcctcttgcaagggctccgctaagtccctgctctaacaagggccttggtggctttgggggttcttctgagagggagaatattagcatcagttaggaggggtagactcacccaagttggccctgcttcctgggctgagagccaagggaggtgttgaattccagccttccccattgacccttgccaggaggctcaagatacccctaaccaggagagggggagaattaataacccttcccttggatgtgatgccagcacccaggcagaaactcctggaaactccagaacttgccgttccacccatctgccctagggcactagttccactgacccttagataccaccctcagaaccattcctggtggctggcctcgtgggcagtctggcagacacccagctgaccttcccatcccggaggtgcctcagctatggagggaagattcttagagcctttgggttatcattctgatggcagagtgggtcctaaaccaatctctggggagtcccaggctctgcatggtgaaggggaaacataggattctgggggaggagtctaggtggtacggtgaggagtcagcctgctgcggaagggtagagggcatgagccaaggccaaacccagagtgacctttcctctctcctctggccccaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgactcctgggctcttgtcaggccaccttgtgcagccccctcatcacgttcaactgcaatgttagacagggacttgattgtctccatggtaactccagctggataagaagcccattgccccagctccccaccaccgccaccaccaccaccacatgcgcactgccaagcagccttccaagagctattgcctcagactcttactccttttttctttccctccaaaccccaatctgggaggccttctgtccctgcctagatctgatgataagggcctctccatcataaggcgctgttcttacccatggtttatctctaagacagaatgctcagttcttgccacccctggagacaactcacccccagctcccagttattgtatgtatctaacccccacagtctggagactccagcacagtagacagttggggggacagaaaggacacacagctgtaccattcacagctacagctctagggcctgccagggcccggagtggcctgggaggctcagcagctagaccctggggatttgtgtgctaggagagcttcagcccctcagggagcagccaggggtcgggggtggggggtccccatcttgcccagctgcccattttcctgtgctgatggcattaacaagaaccatccccaactctgggctgcttctcccatcaatcttttcagtcattttttacaaattttttacttttttctctcctaaaatttctgaacatacagtacaagtatgagctgccttgcaggagaggcagtcttgcagccccagcttcatccagacacatgatgcctatgttcctctgggatgacagagaaaggggaaggaaatgggaggcactccagcatgaggagcaggaattcacacacgggcctccaaatgcccaactgtcccagtgcctgaggtgtcccctgactcagctgagagagttcaacaggtccctaggcccagctcctacatggaggggcaaatccaggcttcccctaggctgggaagagctcatggttggatcctcttgcggtataggtaggcattgctcacctggttcataatgaccaagctggtgaggacagggcataatacagccaggtaccaggctgcaccagtgacagaggcagtgaaccagagtgagcacatgcccagcaagaggctggcactacccagcaggtagcccaccagcccagaagtagcatggtatagcttgagcttcgccaggggccatcggggcagcagcttggggtagagcagccccaccccacctgagcactgcagccctgcccacagcacagccagcagccctgcctgcccatgccgcgtaaccaggtgggctttgccaagctgctctttgtggaggatgacaaggccgaggcccagcagtgcacacagcagggccagcagctgcagcacccagtggcagcgtgctcggcctttccgtgagagggagtgcagcagcgaactctcaggagaaaacaccagtagtgcctcggtcatcaggaaggagaactgaggaaacaggggatgggaagctcaagtgagggtgctgccccagaagaggagaagagggctttatgtaacccttagctgccagtgagtctgggctgattcccctttttctttctctccccactgacaagactatccatttggtggggcaagagtggaaaaccccatctgggatgatatatgtgccctgaataatctccacacttcctcctaggtgccagtctgaaatgtcatctgtcgtatgttaccaagcaaacacagggtttgagatgtggcagttataaatgattcacaagctttgtttccctaacgtggggctggatacaatttcttggcaagagctggccacatgggtgcactgtttcagggaaagttaggtgcatcaccagaaattaaagtaaaaagggacagaggtacatccaaatgcaatgtctcagctttctgcctagaggtgggtgaagcctcattgtgcttagacaaatcttacccatttgacctgggtcctgggtcttcattactctgattcaagtctctttttttttttttttttttttttggagatagtctctctctgtcacccaggctggagtgcagtggcctgatctcggctcactgcaatctccgccttccgggttcaagcaattctcctgcctcaggctcctgagtaactgggattacaggcacctgccaccacacccagctaatttttggttttttggggggtttttttgtttttgggtttttttttttttttgggacagagcctcgctctgtcgcctaggttagaggttagagtgcagtggcgcaatcttggctcactgcaacctccgtctcctgggttcatgcgattctcctgcctcagcctcccgagtagctgggactacaggcgcgtgccaccatgcccggctaattttttgtatttttagtagagacggggtttcaccatgttggccaagatggtctcgatctcctgacctcaggtgatgtgcccgcctcggcctctaagtgctgggattacaggcatgagccaccgtgcccagcctcaagtctgaaatatataccatgggcaggagtagttggagcatgcaactcttccaaacagatattaaatgtggacaaagattcagaggctgccagggccaccaaccatgcccatgctcccacccctaagaactgcccaggcccactacttacagccaaagacataagcaccgggtgccaggagaacaggcctggaatgagaagaggaggcctcatggggctgaggcaagaagaaaccagccataccaatccttaagggttgaggaataccagcagcccatcacccaaggaggtgctgccaaactgtgagccccttcttgctctgcaacaagctgaccccacacctatcctctcttcctggcctcttcctggatcagaggccatgctttgccactcctctggcagtcctccctccttcccttacacctcctgagaggcagccaaatggagcacccagagaaggaaagacaaaccaggaattctgtgtgccctggccatacctacctgctccacctcactcatcgctccagcacagaattccctcaaccagccaggcctgttcccggaagtcccactgcccttcctccccaggaacagtggcccttcccttcccagaagtcagctatgaattctacttactggagccaggcctggcaagcacagccacaaagatggtaaagcccagggccacaaggtgggcggcagcgccagaagcagtacgcagagctcggtagatgtgtgactcggtctccgcagaaagggccatcgtcagccgtgctagtggttgtagcctgaaagcatagtagcgtgggccaggatctcaggtgcccactgttcactcctcactggagaaaaggctgcaaggcaggaatgccaccctcttccaataagttatggtaggaaagaacagtaccaagaccagcaccaggaatggtcacaacatgccagtcgacggccggcggcctgtcaacgtgtacccatgtctgaactggtaccaatcgctggcccgccttccaggtaggaggcgcaaagccatgtaagactacaaatcccagcgtgtaccacgccgtcgccggcagtagagccagctgggagggcgcggagcactatggaaattgtagttccctgctgcggtcccagttacagcgtgaatcccttagcgcaccgcctccccaagtgctgccagcatgctgcccctccacgctagggacttgcctgcctctgccgcagcgcagatctgatgcggtggtttcctccaaagaaagcgggatactccgggccctgccgcgcgcaccgccgctccgtcacggagccgctttacttccgggtgcgacgtctacccacccaggacttcctgggacgagccgtcccccgccccagccacgcctctgagtcgcgctgcgcaggcgccattgggcagagggattggcaagcttgcgtgccccagcgacacaggcctcgaggctgtctctgacaagtgttcacaggaggtggggacgcctctgcgcgaggaacgaggagctacgggcctgggcccggttattgccatgggcagcggctgccgcatcgaatgcatattcttcagcgagttccaccccacgctgggacccaagatcacctatcaggtgccacccgggctcgcgggactgggcgggaagagggacgttctcgagagctcaactggctgcctgaaggcagtagtttcccgtgctgcacgcaggcatgctgcttcattcgcagacaactgtgaggctagaggatagtcagacccaggcccccggctcccaatgtggcagggaagacatacgtcacattggcagtgtttgtaggatatcgggctgtagggatccggttggggggttccaggtcccacagaaggtgagttgggtgacccatgagtatccctgaactgagtgaagagtaaatgatgcataggaagtttaggtaaggcaggagaaagtgttccaggtagagggaacagcatatgcagaagccaggaaggaggtgagatcatagcgtatgtttggaaacagaaagaagtaataggcctgagtggatgggagagaggggaacgctggagaagaggacttgggcttggggggcatgaggaggtcaccatttgtactacacccagtacagatgtccactgaggggcccattgccactcccctccccaggtccctgaagacttcatctcccgagagctgtttgacacagtccaagtgtacatcatcaccaagccagagctgcagaacaagcttatcactgtgtgagaccctagctcggggtgagcggtgggtggcaggggttgtcccaggaggaggaagggacaggcttgggggcctgactgtgttccaattatccagcacagctatggaaaagaagctgatcggctgtcctgtgtgcatcgaacacaagaagtacagccgcaatgctctcctcttcaacctgggcttcgtgtgtgatgcccaggccaagacctgcgccctcgagcccattgttaaaaagctggctggctatctgaccacactagaggtctgcaatgagatgggcttgggtttaccgacaggcagagttggggaaggtgttcccatgtctccaaagtcccccaaacctgggaccctgcaaaccagctcaggactcagggcagccaaccagccaggggtcctgggatgtgcccaccatgctttccatgctctgtctagctagagagcagcttcgtgtccatggaggagagcaagcagaagttggtgcccatcatgaccatcttgctggaggagctaaatgcctcaggccggtgcactctgcccattggtatggccagcctctgcaaggacagcagaggggtagaggagagatgggaaagtgaacccagctagtcagggagaagggcaagactcatgaacacattggtgggcaggaaatagccatgggctgaggtgcccatgtccagggtccaatgcatgatggagctgggactgggggtagggggaaagcagagctctccagctctgccccttgggcaattccttcccctttgtgggcctccgtttctcactccataaaaagagaaagattagccctacccagaggcacctgcttgccccaagggatgctgggaggcctggatggtaattgaggacctcttggaagaagtggcactgaggatatggatggggccccctgcagatgagtccaacaccatccacttgaaggtgattgagcagcggccagaccctccggtggcccaggagtatgatgtacctgtctttaccaaagacaaggaggatttcttcaactcacagtgggacctcactacacaacaagtatgccatccctccctgggtatcatcacctggggctggccacagccctggcctcatcctgtttcttctgaccttgtcccactctgcccagatcctgccctacattgatgggttccgccacatccagaagatttcagcagaggcagatgtggagctcaacctggtgcgcattgctatccagaacctgctgtgagtgggcctacagtcatacctgggacaaggtcaccagccagggaagacctcaggggccctgggtgtgagggttgggaaggcatggtcctcagaagctgagcacagctctctctctcaggtactacggcgttgtgacactggtgtccatcctccaggtaggtgagttgggtttggttaagtggagagtggatcatgtggctggaccagaccagggctgtgtcagcttcccaagcccctcactcaggcccctatgccttctgctaccctctagtactccaatgtatactgcccaacgcccaaggtccaggacctggtagatgacaagtccctgcaagaggcatgtctatcctacgtgaccaagcaaggtagtggtgggttctgggggaagccatcttggggagggcagggccacatgatgagctgatccctggcacccacagggcacaagagggccagtctccgggatgtgttccagctatactgcagcctgagccctggcactaccgtgcgagacctcattggccgccacccccagcagctgcagcatgttgatgaacggtcagaggagaatttgctggggcatttgggagttacctgagggaagctagaccctttatgtctctcaggagccctggatcatggggcactgccaatccaagcaggcttcctggagatgatgggctacagagacaaaattgaagggagactacaggaaagggttggcctgcctgaaagaaggcctggccagggcgtcaccccgtcctctgatcctcaccctaggaagctgatccagttcgggcttatgaagaacctcatcaggcgactacagaagtatcctgtgcgggtgactcgggaagagcagagccaccctgcccggctttatacaggctgccacagctatgacgagatctgctgcaagacaggtggaggcaggcgggcagtcagggtgggttcagggcagggtggccaggccaaggccactgacctctcctccaccaccccacccaggcatgagctaccatgagctggatgagcggcttgaaaatgaccccaacatcatcatctgctggaagtgaggctggtagtgactggatggacacattgctgtgggtagtccctcctactaggaggcttgtcatactgtctagaggttgactcttagttctgtaaataaagacatccatttcaaacagcctttattgagtgctgtttctgggccagccgtgggagacccagcagtgaatgaaatagccacgagccgtgggctagatcgccatctggtgggcaggaccgacaatcgacaaataaaagtgccggttaattacaaaaaaaaaaaaaaaaaaaaaaaaaaatcgtcctgatgcggtgactcacctgtagccccagctactcaggaggctgaagtggggggatcatttgaggccacgagttggaggctacatttagctgtgatcccatcactgcaccccagcctgggtgacagagcaagaccccatctcaataataataataataataaataaacctagaaagaagcagatgtagccaggcgcggtggctcatgcctataatcccagcactttgggaggctgaagcgggcagatcacctgaggtcagatgttcaaaaacagcctggccaacatagtgaaaccccatctccactaaaaaaaaatacaaaaaattagccaggtgtggtggtgcacacctgtaatcccagctactcaggaagctgaggcaggagaatcacttgaacctgggaggcagaggttgcagtgagccaagatcatgccactgcactccagcctaggtgacaggagactcaatttcaaaaaaagatgtgatcaagagtgagttgggttggaggcagggactgctctggattaaatggccaagaaaggccatgctgaggtgtaaactgagccctgaaggaaaagtattccaggcaaagtgcaaaactctgaggcaaaaacctctttggaatgtatgagggaggttcagggaagcaaggaggagaggaaagaatccaagtcccgaggtacaggagaggacaagaagtagatcttgcagagctgctagtaagcggcatcccacctaacattttgagggccagaagtagccacagagcccctctcacgcaagggagtaatgtctatatgctttttttttttttttgagacggtctccctttgttgtccaggctggagtgcggtggtgcaatcttgcctcactgcaaactccacctcctgtgctcaagcgattctcctgcctcagtctcccatgtagctgggactacaggtgtgtgctaccacacctgtctaatttttgtacttttagtagagacagggtttcaccatgttgcccaggctggtctcaaactcctgacctcaagtgatccgcctgcctcggcctcccaaagtgctgagattacaggtgtcagccaccgcgcccggcctgatatacacttttaaggctccgggctgtccatgaggatcaagcgtggaagtaggtctacagaaaaggctgccgcagttcacccatgacaggtgatgacagtctggacatagggaggatggagagaagtcgtgcgccctggcagtatttcaggagccaactagtggagccgggacgcgagaaatagaggaaccaagaagccataaggaggaggaagagcagcgggtaggtcaagatgccacagccgcaggaggggctgttggggtcggggttacccccatccctgtgcaggcggacttggcgtctgaggacagagtccagaccacaaggatctggagctcaggagagactcgtgggccacagcccgagaaagcgctgggaatccaaatactatggcgattggcagtcgcgtaggcgaggcgggctagagacccgcccggatttaggcgcgagccacctccaggggcggggcccaggccgcactgcgcaggcgcggctaacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtgaggcacccgggtcaggcggagtcccggagtcattgtccttgagtcggggagctggggcctgactcgggggaggggctgcccagtgtggaggggctcccaaatgggggagcagagcgttccgagacaggagtattactgctcctgagccccctgtgtcccctcaggatcaggttaggcttcagtaggatccagcccccatccccactcctaatgcacacacgtggacgcacatgcacttaccctctgaggcaggtggaaccagcagcatgagaacctggagaagctgaacatgcaagccatcctcgatgccacagtcagccagggcgagcccattcaggagctgctggtcacccatgggaaggtaccccgaggtcacaggcagggttcctgccttcccccatacctcacctactctacccctccggagtcccctgtgtgcccttcccctctggcctggtacacctgttctccctgaaggacaaagaggaatgtgttacatgtttcattttgtatccctattggacaggactctggcacaccaggctgggtgcagggcatgagttgattagggagaaagctgtaggtcctagaacagcttaggcttcaaggggaaggcccaaatgctaaaggcatctgtgaattgactgtaaggctggtggtggggaaggggtggggaggggttggggagggcgggagggaggggagataacctaactggaggtggaacttcggcatggaaggaagcagccttcccaacatgaaagggggaagttagaaaccagggagatgcctggctggaacatggaccagggagtgtcaccagcagatgacctgagatatcaattgaccaaaaaaaaaaaaaaaaaagccgggcatggtagctcatgcctgttatcccagcattttgggaggccaagacgggtggatcatctgaggtcaggagttcaaggccagcctggccaacatggtgaaaccccacctctactaaaaatacaaaaatttgcagagcatggtggtgcacacctgtaatcccagctactcgggaggctgaggcaggagaatcgcttgaacctgggaggcagaggttacagagagccaagatcatgccactgcactccagcctgggtgacaagagtgaaactccgtctcaaaaaaaaaaaaaaaaaaaagaaaggtcctttgcaaaagaaagatggaactcatactaggggataggataggaacagggcactgtgaagggtcctgagtaggagtgaggccaaggcacacaagagctttggaggaccacagacagggactagagggagggcatgaggagaagggctggcttgaaagggatgcctgaatgggcgggcagaggataagggtgcaggtgcaggcagggcaaggcagtctgggaactgggcaggagccagtcacataagcatgagggacatccacagaggtgttgggagcagctggtaatgaaggtccaaggtgcaagagagaagtcaggaaggatactcatgggtctggaatagtttaggggcccagcagtgtttggggatatcagggttgagctgagccggggatgggagggttgccaggcaaaggtaggcccatctcatccctgtcctttaccctacccttcaaaggtcccaacactggtggaggagctgatcgcagtggagatgtggaagcagaaggtgttccctgtgttctgcagggtggaggacttcaagccccagaacaccttccccatctacatggtggtgagctgggcccctggttcatacctcttctcactccttcagagggctctggaccggggaggagagctggtagcccctatcccttcctcaggccctgtccttctctttatctgacaggtgcaccacgaggcctccatcatcaacctcttggagacagtgttcttccacaaggtgagggactatctctgcccatgggccacagttccgggtcagggcctggcaggaagggagattgtgtctgtgtggggaaggcatcagacacagaaagtttccctcctccttttcccaggaggtgtgtgagtcagcagaagacactgtcttggacttggtagactattgccaccgcaaactgaccctgctggtggcccagagtggctgtggtggcccccctgagggggagggatcccaggacagcaaccccatgcaggtgggttgaggttacctagggttgtgaaagcctaggtctgggttccccaaggcctgcgcaggtgagggtggcccagcgtgaacactgtgtgacctcccaggagctgcagaagcaggcagagctgatggaatttgagattgcactgaaggccctctcagtactacgctacatcacagactgtgtggacaggtgagcagtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaaggtcagactccctccgcaccagcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacaggtaggcactggaaagttagctgctcaggaccactgtcccactttaccagcaccttcctgccactctccacttctctctcctagatcccagaaatctgggagcggctggagcgagaaaacagaggcaagtggcaggcaattgccaagcaccagctccagcatgtgttcagcccctcagagcaggacctgcggctgcaggcgcgaaggtaaggcctgtggaaatggcagggagggtggaggggatgcaggaggcatggatgtgggtggggtgcccccaccttccagggccagtcagaccttcctgactttcccccaggtgggctgagacctacaggctggatgtgctagaggcagtggctccagagcggccccgctgtgcttactgcagtgcagaggcttctaagcgctgctcacgatgccagaatgagtggtattgctgcaggtgagggtatcctagaaccttggacctctaagccctactcccacatcccccacatgcattgccatcctcaatacccacctgcctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacgggtatctccgcgtggtgctttgcggtcgccgtcgttgtggccgtccggggtggggtgtgaggaggggacgaaggagggaaggaagggcaaggcggggggggctctgcgagagcgcgcccagccccgccttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgtgagtagtggccccgcgcgcctacgagagcggaaggggcagccaaggggcagcgcagtcgccgcgggtcaagtcgcggcagagggggtcggcggggacagctcccgaggactaggtccgttactttcgccccatcgctgaagagtgcgcgaaaatggtttatcccttgtcgcactccactcgtatctgggccacagatgagcagaggtggctgcttatatgtaaaaatacgctgattttaagtttcttatctttaaaatgccttggcccttcttgagaaagggtttgtgcctactgtcctcggagtccatcttcccaggcttgcctcttctcaaacactcatgaccccctccagaacctttagggtgaagggaaattaccacctatgggagggagcctggaaaaatttagaacctttggtgggccccctgcaagcaggagttttgttgagtctttatttagcaaacacccttttctgacccagtgaatcagatgctaaaatatgcacgcagccacacacccagcagtccttctgcacccctgggaatcgccagcaagcaaaggttgctctcccctgggtagacaccagctggaatcaccaggggtgcttttacagtcctccccgctagcctggatcccaccgcagacctgttgaatcaactgctgggagtggaccctaggcatcagtaaattttaaaaactccccaaattattgtaacatggagtctgggttgagcatcactgctctggcctatttaggaacttgtggatggatagtgtcccaggtctgtgtgtgcatggagaccctctcatccggtacaagaggacatcacaaattcagctggggggagcacaaagttgtgacagaatgcaaagaatgaacaaggggccgagcgcggtggctcatgcctgtaatcccagcacttcggaaggcggaggcgggtggatcacctgaggtcaggagttcaagaccagcctggccaacatggtgaaacctcatgtctactaaaaaataaaaaaaaatgagccaggcgtagtggcgggtgcctgtaatcccagctactcgggaggctgaggtgggagaattgcttgaacacaggaggcggaggttgcagtgagccgagatcgtgccactgccctccagccttggcgacagagtgagactctgtctcaaaaaaaaaaaaaaaaaaaaaaagaacaaggctgggacattgcagcgttctcaaagagaaataaagtagccatggagataagaagcaggatgatttgggcatgtttatcagaggtagagacaagggagaaatcaaagataagtttgggcttttgtctccagtaactgggagcctagtggccatttttgctgcaaagaggaagctgggcaagtgtagcagtgaggctgaagaaaagggaattaaattttggccatgttcacttgaaacgtcttttagacatcctagtgaaggtactggcacggaggatctagtctgagggtttaggtcagtgtttcagccgtggatctggggcagatgaatgtagacagaccaggccagtgatcaggactgagcccagacttcatcgtgagatatggaagttgagtcagaatctgcaaaggagctgagcaggagctgcagggggtaggaggaaaactgggagagtgtagcccctgggagtcaaagggagcaagcttcaaatgatgctgagggggtgagaatggagaatggaacactggattccatttggtagtacacagatcgctgaggaccctgtcccgggcagtttcctggaggaagaggcaagcctggctggagtgggtagaggggagagtgaaggcgaaggattagagtgtatagagaccagtgtcttggtctgaggggagtagagacaggtgacaaccacagggcagacgtaggttaaaggtgtttagtttttccttcaagtaaatgggcagatgtattccatatacgttcccagtgaagggccgggtgcggtggctcaagcctgtagtcccagcactttggaaggccgaggcgggtggatcacctgagatcaggagtttgagaccagcctggctaacatggtgaaaccccgtctctactaaaaatacaaaaattagctgggcatggtggcgggcgcctgtaatcctaggtactcaggaggctgaggcagaagaatcgcttgaacccaggaggcggaggttgcggtgagccgaaatcgcgccattgcactccagcctgggtgacaaaagcaagacgcagttttttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaagtattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcagactttttacctggaagctttctggctccaaggtattaggcctgtggagtgaaattagactcagaatatgcctgacctgtccacaggtaattggggaacatctgacttggttgtctcagtaaggtgaccgttttgtagggcccatcttccatacaaactgctgtcagggatcctaccagagatcattcagccaagagcctgacatcagaaagcccagtcctagcttgtgtgaacatgaggtgctagtcttctctggggagggtctgctggcttggccatcccttctgcagcctgtacactccccttttgccccttgcagtgggacgccttcagcatgcctgaactacataacttcctacgtatcctgcagcgggaggaggaggagcacctccgccagatc

SEQ ID NO: 22 - DNA, 20 bp, artificial sequence
  RASSF1A forward primer
attgagttgcgggagttggt

SEQ ID NO: 23 - DNA, 20 bp, artificial sequence
  RASSF1A reverse primer
acacgctccaaccgaatacg

SEQ ID NO: 24 - DNA, 18 bp, artificial sequence
  RASSF1A probe oligo (6FAM--BHQ-1 format)
cccttcccaacgcgccca

SEQ ID NO: 25 - DNA, 1094 bp, Homo sapiens
  misc_feature (304)..(397): Amplicon location
ctccggctggccccttctgtaggatggtagcacacaaccaggtggcagccgacaatgcagtctccacagcagcagagccccgacggcggccagaaccttcctcctcttcctcctcctcgcccgcggcccccgcgcgcccgcggccgtgccccgcggtcccggccccggcccccggcgacacgcacttccgcacattccgttcgcacgccgattaccggcgcatcacgcgcgccagcgcgctcctggacgcctgcggattctactgggggcccctgagcgtgcacggggcgcacgagcggctgcgcgccgagcccgtgggcaccttcctggtgcgcgacagccgccagcggaactgctttttcgcccttagcgtgaagatggcctcgggacccacgagcatccgcgtgcactttcaggccggccgctttcacctggatggcagccgcgagagcttcgactgcctcttcgagctgctggagcactacgtggcggcgccgcgccgcatgctgggggccccgctgcgccagcgccgcgtgcggccgctgcaggagctgtgccgccagcgcatcgtggccaccgtgggccgcgagaacctggctcgcatccccctcaaccccgtcctccgcgactacctgagctccttccccttccagatttgaccggcagcgcccgccgtgcacgcagcattaactgggatgccgtgttattttgttattacttgcctggaaccatgtgggtaccctccccggcctgggttggagggagcggatgggtgtaggggcgaggcgcctcccgccctcggctggagacgaggccgcagaccccttctcacctcttgagggggtcctccccctcctggtgctccctctgggtccccctggttgttgtagcagcttaactgtatctggagccaggacctgaactcgcacctcctacctcttcatgtttacatatacccagtatctttgcacaaaccaggggttgggggagggtctctggctttatttttctgctgtgcagaatcctattttatattttttaaagtcagtttaggtaataaactttattatgaaagtttttttttttaaaaaaaa

SEQ ID NO: 26 - DNA, 21 bp, Artificial sequence
  SOCS1 forward primer
gcgtcgagttcgtgggtattt

SEQ ID NO: 27 - DNA, 21 bp, artificial sequence
  SOCS1 reverse primer
ccgaaaccatcttcacgctaa

SEQ ID NO: 28 - DNA, 26 bp, artificial sequence
  SOCS1 probe oligo (6FAM--BHQ-1 format)
acaattccgctaacgactatcgcgca

SEQ ID NO: 29 - DNA, 866 bp, Homo sapiens
  misc_feature (315)..(315): n is a, c, g, or t
  misc_feature (759)..(832): amplicon location
acttatatatctgacagttgatttgtcctcacctctaaattggaatttaagcatcacctggttcgatttaatgcaatgtagaatttgcattaaaatactacattaaagcctcagatttgtagtagctaacagcacttctatgtatgtgtcagggactgctctaaatacttcatatatattaactcctctattctgtacttctgttcccgttttatacagcaggaaattgaaacactgagaggttaagtaactaaagttacagagctagagtgacaggagtaaagcttcaactcaggcaacccagacgtccagagntctgatctccactactaagctgctagcatagcttttctggtaactatttttaattcaatataattcgaatgatctatctaacaagtcatcactctgacaactcagtgacttgtaatgtaaaattattcattgtaattcacttaatattattgtttctctgtgctgcaaaaatcatagcaatcgagatgtaatttattactctccctcccacctccggcatcttgtgctaatccttctgccctgcggacctcccccgactctttactatgcgtgtcaactgccatcaacttccttgcttgctggggactggggccgtgagggcatacccccgaggggtacggggctagggctaggcaggctgtgcggttgggcggggccctgtgccccactgcggagtgcgggtcgggaagcggagagagaagcagctgtgtaatccgctggatgcggaccagggcgctccccattcccgtcgggagcccgccgattggctgggtgtgggcgcacgtgaccgacatgtggctgtattggtgcagcccgccagggtgtcactg

SEQ ID NO: 30 - DNA, 19 bp, artificial sequence
  APC forward primer
gaaccaaaacgctccccat

SEQ ID NO: 31 - DNA, 27 bp, artificial sequence
  APC reverse primer
ttatatgtcggttacgtgcgtttatat

SEQ ID NO: 32 - DNA, 22 bp, artificial sequence
  APC probe oligo (6FAM--TAMRA format)
cccgtcgaaaacccgccgatta

SEQ ID NO: 33 - DNA, 1984 bp, Homo sapiens
  misc_feature (9)..(9): n is a, c, g, or t
  misc_feature (17)..(18): n is a, c, g, or t
  misc_feature (33)..(33): n is a, c, g, or t
  misc_feature (41)..(41): n is a, c, g, or t
  misc_feature (49)..(50): n is a, c, g, or t
  misc_feature (52)..(52): n is a, c, g, or t
  misc_feature (54)..(54): n is a, c, g, or t
  misc_feature (62)..(62): n is a, c, g, or t
  misc_feature (80)..(80): n is a, c, g, or t
  misc_feature (84)..(84): n is a, c, g, or t
  misc_feature (127)..(127): n is a, c, g, or t
  misc_feature (157)..(157): n is a, c, g, or t
  misc_feature (159)..(159): n is a, c, g, or t
  misc_feature (175)..(175): n is a, c, g, or t
  misc_feature (207)..(209): n is a, c, g, or t
  misc_feature (214)..(214): n is a, c, g, or t
  misc_feature (1181)..(1181): n is a, c, g, or t
  misc_feature (1680)..(1782): amplicon location
agcttcagncatcactnncatctttatcaatgnccttgggnccacaggnngngnccttctgnccaaacagcagccaatgnaggnatcttaaaaggcacatcactttatatttattcagtggttatgncatcacttaatcctcaccacaaccttgtgngntcagtacaatttgtgntttcattttatctgtgaacaaatggaggcagnnntttgngtaatttacaagtaagtggcagatccgggggctgtgcctagacaatgtggctccagactccttgcccctccctgccttctgctgcatcttgattgagtctagccatctatttctttaacacacactaattgctgtctccatgttccaggccctgtgccagatgctagaaatacatccccatccactggatcttggcatggtccattgctcagtgtcctgctatgttacgtgttacataatgcatttattccggtatttagcccatggaaaataatgctgaaagacattgtatgcatgtttctacaacaaaactatgtaacttatgtttcttttattgctttggctatcaggaagctcttatccaaatcagagcaaatacattagaatttgggcttgtcatttcagtttgctgaacttttccttctggcccagattttctattttggttcataaattctattgcacaaatgtcctttattgtaaaacaccttaaattctttctaagggaaggctgcatggaaatgatacagtaaggtcttccctgcattttcttagattcctattagggaaggcagacctagatgtccctcttaccctcagtcccaaagccccccatttataaaatcccttaagcagtgactactgctgttctgagtacctggaggtagttcagagcttctgaaaggtaaaatccatatacaaaaagaagttccttccgatccagatcccagctttggtgccagatgcacatttgaggagtaggtggctagtcagactctcacctgagcagttaataaaatctattgccccttaatggaattttttctgcaagctcgaattgatctgtcatctttgtgatttgtgagatggcagggaagcaccaaacaccatcatgacttgggccacagtggtgggaaaaaaggaaaaaagaaaaaaaaaatccactgccaagccttgccaggcgtanaaagggctggaactgctggggccattttatctgatttattggaaatagagtggatcttattaacattttaataaagagaatctttttgcactaggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgcgtgtgtgtgtgtgtgtgtgtgtgtgtgtgtgtgtgtgtgtgtgtgtgtacgttcgttaacgggagga

SEQ ID NO: 34 - DNA, 21 bp, artificial sequence
  CDH13 forward primer
aatttcgttcgttttgtgcgt

SEQ ID NO: 35 - DNA, 20 bp, artificial sequence
  CDH13 reverse primer
ctacccgtaccgaacgatcc

SEQ ID NO: 36 - DNA, 20 bp, artificial sequence
  CDH13 probe oligo (6FAM--BHQ-1 format)
aacgcaaaacgcgcccgaca

SEQ ID NO: 37 - DNA, 2011 bp, Homo sapiens
  misc_feature (91)..(162): amplicon location
tttcagtttctccagctgctggctttttggacacccactcccccgccaggaggcagttgcaagcgcggaggctgcgagaaataactgcctcttgaaacttgcagggcgaagagcaggcggcgagcgctgggccggggagggaccacccgagctgcgacgggctctggggctgcggggcagggctggcgcccggagcctgagctgcaggaggtgcgctcgctttcctcaacaggtggcggcggggcgcgcgccgggagaccccccctaatgcgggaaaagcacgtgtccgcattttagagaaggcaaggccggtgtgtttatctgcaagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacagagagacactgaaaaggaaggttagtgggaaccgttgcgccagccctgttactggtccaggttcaaagagggatgctcacttctgcgctgtctgcagcgattacgcatcgggatatcactatggagtctggtcgtgtgaaggatgtaaggccttttttaaaagaagcattcaaggacataatgattatatttgtccagctacaaatcagtgtacaatcgataaaaaccggcgcaagagctgccaggcctgccgacttcggaagtgttacgaagtgggaatggtgaagtgtggctcccggagagagagatgtgggtaccgccttgtgcggagacagagaagtgccgacgagcagctgcactgtgccggcaaggccaagagaagtggcggccacgcgccccgagtgcgggagctgctgctggacgccctgagccccgagcagctagtgctcaccctcctggaggctgagccgccccatgtgctgatcagccgccccagtgcgcccttcaccgaggcctccatgatgatgtccctgaccaagttggccgacaaggagttggtacacatgatcagctgggccaagaagattcccggctttgtggagctcagcctgttcgaccaagtgcggctcttggagagctgttggatggaggtgttaatgatggggctgatgtggcgctcaattgaccaccccggcaagctcatctttgctccagatcttgttctggacagggatgaggggaaatgcgtagaaggaattctggaaatctttgacatgctcctggcaactacttcaaggtttcgagagttaaaactccaacacaaagaatatctctgtgtcaaggccatgatcctgctcaattccagtatgtaccctctggtcacagcgacccaggatgctgacagcagccggaagctggctcacttgctgaacgccgtgaccgatgctttggtttgggtgattgccaagagcggcatctcctcccagcagcaatccatgcgcctggctaacctcctgatgctcctgtcccacgtcaggcatgcgagtaacaagggcatggaacatctgctcaacatgaagtgcaaaaatgtggtcccagtgtatgacctgctgctggagatgctgaatgcccacgtgcttcgcgggtgcaagtcctccatcacggggtccgagtgcagcccggcagaggacagtaaaagcaaagagggctcccagaacccacagtctcagtga

SEQ ID NO: 38 - DNA, 26 bp, artificial sequence
  ESR2 forward primer
tttgaaatttgtagggcgaagagtag

SEQ ID NO: 39 - DNA, 20 bp, artificial sequence
  ESR2 reverse primer
acccgtcgcaactcgaataa

SEQ ID NO: 40 - DNA, 18 bp, artificial sequence
  ESR2 probe oligo (6FAM--TAMRA format)
ccgacccaacgctcgccg

SEQ ID NO: 41 - DNA, 4261 bp, Homo sapiens
  misc_feature (1146)..(1245): amplicon location
aacaagagatcaatatctagaataaatggagatctgcaaatcaacagaaagtaggcagcaaagccaaagaaaatagcctaaggcacagccactaaaaggaacgtgatcatgtcctttgcagggacatgggtggagctggaagccgttagcctcagcaaactcacacaggaacagaaaaccagcgagaccgcatggtctcacttataagtgggagctgaacaatgagaacacatggtcacatggcggcgatcaacacacactggtgcctgttgagcggggtgctggggagggagagtaccaggaagaatagctaagggatactgggcttaatacctgggtgatgggatgatctgtacagcaaaccatcatggcgcacacacctatgtaacaaacctgcacatcctgcacatgtaccccagaacttcaaataaaagttggacggccaggcgtggtggctcacgcctgtaatcccagcactttgggaagccgaggcgtgcagatcacctaaggtcaggagttcgagaccagcccggccaacatggtgaaaccccgtctctactaaaaatacaaaaatcagccagatgtggcacgcacctataattccacctactcgggaggctgaagcagaattgcttgaacccgagaggcggaggttgcagtgagccgccgagatcgcgccactgcactccagcctgggccacagcgtgagactacgtcataaaataaaataaaataacacaaaataaaataaaataaaataaaataaaataaaataataaaataaaataaaataaaataaaataaaataaaataaagcaatttcctttcctctaagcggcctccacccctctcccctgccctgtgaagcgggtgtgcaagctccgggatcgcagcggtcttagggaatttccccccgcgatgtcccggcgcgccagttcgctgcgcacacttcgctgcggtcctcttcctgctgtctgtttactccctaggccccgctggggacctgggaaagagggaaaggcttccccggccagctgcgcggcgactccggggactccagggcgcccctctgcggccgacgcccggggtgcagcggccgccggggctggggccggcgggagtccgcgggaccctccagaagagcggccggcgccgtgactcagcactggggcggagcggggcgggaccacccttataaggctcggaggccgcgaggccttcgctggagtttcgccgccgcagtcttcgccaccagtgagtacgcgcggcccgctccccggggatggggctcagagctcccagcatggggccaacccgcagcatcaggcccgggctcccggcagggctcctcgcccacctcgagacccgggacgggggcctaggggacccaggacgtccccagtgccgttagcggctttcagggggcccggagcgcctcggggagggatgggaccccgggggcggggagggggggcaggctgcgctcaccgcgccttggcatcctcccccgggctccagcaaacttttctttgttcgctgcagtgccgccctacaccgtggtctatttcccagttcgaggtaggagcatgtgtctggcagggaagggaggcaggggctggggctgcagcccacagcccctcgcccacccggagagatccgaacccccttatccctccgtcgtgtggcttttaccccgggcctccttcctgttccccgcctctcccgccatgcctgctccccgccccagtgttgtgtgaaatcttcggaggaacctgtttacctgttccctccctgcactcctgacccctccccgggttgctgcgaggcggagtcggcccggtccccacatctcgtacttctccctccccgcaggccgctgcgcggccctgcgcatgctgctggcagatcagggccagagctggaaggaggaggtggtgaccgtggagacgtggcaggagggctcactcaaagcctcctgcgtaagtgaccatgcccgggcaaggggagggggtgctgggccttagggggctgtgactaggatcgggggacgcccaagctcagtgcccctccctgagccatgcctcccccaacagctatacgggcagctccccaagttccaggacggagacctcaccctgtaccagtccaataccatcctgcgtcacctgggccgcacccttggtgagtcttgaacctccaagtccagggcaggcatgggcaagcctctgcccccggagcccttttgtttaaatcagctgccccgcagccctctggagtggaggaaactgagacccactgaggttacgtagtttgcccaaggtcaagcctgggtgcctgcaatccttgccctgtgccaggctgcctcccaggtgtcaggtgagctctgagcacctgctgtgtggcagtctctcatccttccacgcacatcctcttcccctcctcccaggctggggctcacagacagccccctggttggcccatccccagtgactgtgtgttgatcaggcgcccagtcacgcggcctgctcccctccacccaaccccagggctctatgggaaggaccagcaggaggcagccctggtggacatggtgaatgacggcgtggaggacctccgctgcaaatacatctccctcatctacaccaactatgtgagcatctgcaccagggttgggcactgggggctgaacaaagaaaggggcttcttgtgccctcaccccccttacccctcaggtggcttgggctgaccccttcttgggtcagggtgcaggggctgggtcagctctgggccaggggcccaggggcctgggacaagacacaacctgcacccttattgcctgggacatcaaccagccaagtaacgggtcatgggggcgagtgcaaggacagagacctccagcaactggtggtttctgatctcctggggtggcgagggcttcctggagtagccagaggtggaggaggatttgtcgccagtttctggatggaggtgctggcacttttagctgaggaaaatatgcagacacagagcacatttggggacctgggaccagttcagcagaggcagcgtgtgtgcgcgtgcgtgtgcgtgtgtgtgcgtgtgtgtgtgtacgcttgcatttgtgtcgggtgggtaaggagatagagatgggcgggcagtaggcccaggtcccgaaggccttgaacccactggtttggagtctcctaagggcaatgggggccattgagaagtctgaacagggctgtgtctgaatgtgaggtctagaaggatcctccagagaagccagctctaaagcttttgcaatcatctggtgagagaacccagcaaggatggacaggcagaatggaatagagatgagttggcagctgaagtggacaggatttggtactagcctggttgtggggagcaagcagaggagaatctgggactctggtgtctggcctggggcagacgggggtgtctcaggggctgggagggatgagagtaggatgatacatggtggtgtctggcaggaggcgggcaaggatgactatgtgaaggcactgcccgggcaactgaagccttttgagaccctgctgtcccagaaccagggaggcaagaccttcattgtgggagaccaggtgagcatctggccccatgctgttccttcctcgccaccctctgcttccagatggacacaggtgtgagccatttgtttagcaaagcagagcagacctaggggatgggcttaggccctctgcccccaattcctccagcctgctcccgctggctgagtccctagcccccctgccctgcagatctccttcgctgactacaacctgctggacttgctgctgatccatgaggtcctagcccctggctgcctggatgcgttccccctgctctcagcatatgtggggcgcctcagtgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagctactatgagcactgtgtttcctgggacggggcttaggggttctcagcctcgaggtcggtgggagggcagagcagaggactagaaaacagctcctccagcacagtcagtggcttcctggagccctcagcctggctgtgtttactgaacctcacaaactagaagaggaagaaaaaaaaagagagagagaaacaaagagaaata

SEQ ID NO: 42 - DNA, 23 bp, artificial sequence
  GSTP1 forward primer
gtcggcgtcgtgatttagtattg

SEQ ID NO: 43 - DNA, 23 bp, artificial sequence
  GSTP1 reverse primer
aaactacgacgacgaaactccaa

SEQ ID NO: 44 - DNA, 29 bp, artificial sequence
  GSTP1 probe oligo (6FAM--TAMRA-1 format)
aaacctcgcgacctccgaaccttataaaa

SEQ ID NO: 45 - DNA, 1874 bp, Homo sapiens
  misc_feature (1581)..(1651): amplicon location
agaccagggcatatctcagtccttatctcaaccacataagacagagcagccgtttatagacctccccccaggaatgcattcctttaccagggtattaatattaatattccttgctaggaaaagaatttagtgatatcttccctacttgcacgtccgtttataggctctctgcaagaagaaaaatatggctgtttttgcccaaccccgcaggcagtcagcccatatggttgacttcccttgttccctaaaaattgctgttattctgttctttttcaaggtgcactgatttcatattgttcaaacacacatgttttacaatcaatttgtacagttaacacaattatcacagtggtcctgaggtgacgtacaccttcagcttacgaagataacaggattaagagattaaagtaaagacaggcataagaaattataaaagtattatttgggaactgataaatgtccgtgaaatcttcacaatttatgttcctctgctgcggctctagcaggtccctctgtttggggtccatgacttcccgcaacatccaatcaatcctccataatgggcaaagtgactttccatagtgtaaatgtgttcccaccactctctggagtaatcctacttaaaaccgttttcagcacaaaattcaaacatctaaacatgatcttgctggctttgcttttgtggctttaccctctttctccccaaacctagctagtgtttgtgctgcctgtaatgcccttctttctttgcaggggtcgccactttaggtcctggtcctccttcagaaagtttttcctctttctccccagcggggatagggtctgtttattttgacaccattagctcacttacacacattggacacaagtctaggctgcaccgttattgaaagtttaccatctgactctgagtagcatgaggatcctatcaaaactcaggagttgctcagtaaatgttgattgaactatgactgttctcaacatacaaacgcaagatcatttaggaacacttgtcaaaatgtttttgccccttgagattctattttgggaggtaagcagtgggggtccaggactctgcattttgacagtcccctgatgtttgcatgtagaagtgcagggattattacactgacaaatctttaccatccctaagggggactttccttcccaggggctatctctggaagcccctcaaggataggggccgcatgctgtttctctaggtcagcaactaaacccagaaaacgtttattgagtgaatgatgaaacgacaggtgaatagatgaacgcaaggtgtcgagttaactattcttctacacaagtcctagcagctcccattgcttccagccgcagaaatggcccctggaaggcaagtcttccagcgagtggagtcactcttaactacatttcccaggattccaagggagccgcgcgctctgcgctcatcttcctaccagaaatcggcaagtcactgaccctcgtcccgcccccgccattccccgcctcctcctgtcccgcagtcggcgtccagcggctctgcttgttcgtgtgtgtgtcgttgcaggccttattcatgggctcaccgctgaggttcgacgggcgggtggtactggtcaccggcgcgggggcaggtgagcatgcgaaggttggaggccgcgccccttgctgaggcgcagctggctgctcttttcgggccggcatacgcgcgcagccgcagctgaggtcaccccgctgaagtggtggggaggggaatggttattcttgaggcaccgcatctcttgaggaggaaagagccggaaacacctggtctctcaagcaggtacagcccgcttctccccagcaccccggtgtgggcttcccaaggtcctgcctga

SEQ ID NO: 46 - DNA, 20 bp, artificial sequence
  HSD17B4 forward primer
tatcgttgaggttcgacggg

SEQ ID NO: 47 - DNA, 21 bp, artificial sequence
  HSD17B4 reverse primer
tccaaccttcgcatactcacc

SEQ ID NO: 48 - DNA, 22 bp, artificial sequence
  HSD17B4 robe oligo (6FAM--BHQ-1 format)
cccgcgccgataaccaatacca

SEQ ID NO: 49 - DNA, 952 bp, Homo sapiens
  misc_feature (254)..(341): amplicon location
ggatcctctgccttgtgatatctggagataagtcaacgccttgcaggacgcttacatgctcgggcagtacctctctcagcaacacctccatgcactggtatacaaagtccccctcaccccagccgcgacccttcaaggccaagaggcggcagagcccgaggcctgcacgagcagctctctcttcaggagtgaaggaggccacgggcaagtcgccctgacgcagacgctccaccagggccgcgcgctcgccgtccgccacataccgctcgtagtattcgtgctcagcctcgtagtggcgcctgacgtcgcgttcgcgggtagctacgatgaggcggcgacagaccaggcacagggccccatcgccctccggaggctccaccaccaaataacgctgggtccactcgggccggaaaactagagcctcgtcgacttccatcttgcttcttttgggcgtcatccacattctgcgggaggccacaagagcagggccaacgttagaaaggccgcaaggggagaggaggagcctgagaagcgccaagcacctcctccgctctgcgccagatcacctcagcagaggcacacaagcccggttccggcatctctgctcctattggctggatatttcgtattccccgagctcctaaaaacgaaccaataggaagagcggacagcgatctctaacgcgcaagcgcatatccttctaggtagcgggcagtagccgcttcagggagggacgaagagacccagcaacccacagagttgagaaatttgactggcattcaagctgtccaatcaatagctgccgctgaagggtggggctggatggcgtaagctacagctgaaggaagaacgtgagcacgaggcactgaggtgattggctgaaggcacttccgttgagcatctagacgtttccttggctcttctggcgccaaaatgtcgttcgtggcagggg

SEQ ID NO: 50 - DNA, 30 bp, artificial sequence
  MLH1 forward primer
cgttatatatcgttcgtagtattcgtgttt

SEQ ID NO: 51 - DNA, 18 bp, artificial sequence
  MLH1 reverse primer
ctatcgccgcctcatcgt

SEQ ID NO: 52 - DNA, 22 bp, artificial sequence
  MLH1 probe oligo (6FAM--TAMRA format)
cgcgacgtcaaacgccactacg

SEQ ID NO: 53 - DNA, 7273 bp, Homo sapiens
  misc_feature (6779)..(6924): amplicon location
ggtacccaggctggagtgcactggtgtgatcatagctcactaacctcgaactcctgggcttaggcaatcctcttgccttggcctcccaaagtgccaggattacaggcatgagccaccacagtggagctctcaattctgatactaataatttgtgtcttctctttttttccttagcctgactagagtaattaactttatgtcttttaaaagaaccacctttttggttttacccattttcttttttgattttctgtttttgatttgattgatatctactctaattttttattatttcttttcctctgcttactttgaatttaattacttttcttttttgtagtctcctaaaatagaagcttatattattgattttagatctttcttcttttctattacagcactcaatgctataaatttccctctaagcattgctttcactgcatcctacaatatttcaactctattgttatttagctcaaaagaggttcttaatttctattgggatttctctttgacccatgtgttattcagaagtgttccgtgtgatctccaaatatttgggagtttttcagctatctttctattaatcatttcttgtttaattctattgtggcctgagagcatatattgtatgatttatattcttgtaaatgtgttaaggtgtgtcttatggtgcagaatgcggtttatcttgctatatgttccttagagaataatgtatgttctgctgttattggataaagtagtctatagatgtcagttacatctcgttgattaatggtgctgttgagttcagctatgtcctaaatgattttctgtctgctgtatctgtctatttctgacacaaggctgttgaagtctccaaccataataatgaattaatctatttttctttgcagttttatcaattttgtcttatatatattgatgctccattgtttggcacatacacattaagaattgttatgtcttcttggagaatttacctttccataacatgtaacatttccctttattcctgataatttttcttgctcaaaagtttgccctgttggaaattaccagaactactctggctttatttgattagtgttagcatgctctctctttctctattcttacacttttaatgtatacttgactttgtatttaaagtggggttcttatagaaaacatatacttggtagggtgggaagtaaaataaaaagaaatacttgggtattggtttgatccactctaacaatctctatgttttaattgatgtatttagaccattgatacttatttttttatcctcatccctgtgattacccagagagctgcttaaattgattattgatatagacaaattaataattaatatctaccgtttgttactgttttctatttttcattgcccttactttctgctcctattttttgctcctttttctgttaatttaggttttgagttattttatatcattctattttctctcccttctcagcatatgaattatctttctttttgacttttttagtggctgccctgaaggttgcaatgtacatttacaaccagtcccaatctcctttcaaaaaacacaatactgtttcatggctagtgcaagtacctaataataagaagtcactcctaatttctttctctcattctttgtatctttactgttattcatttcacttgtacataagctgtaatctttcaatacattattgctattattatttcaaaacatgttatctattatatctatttaaaataagaaaaataggccaggtgcagtggcttactcatgtaatcccagcactttgggagaccgatggattgctagagctcaggaattcgagaccagcctgggcaacatagtgaaaccctgtctctactaaaaatacaaaaaaaaaaattgctgggcatggtggcatgggcctgtggtcacagctactcgggaggctgaggtgagaggattgcttgagcctgggaggcagaggttgcagtgaaccaaaatcaagctactgcactccagcctaagtgacagagtgagaccctgtctcaaaaaaaaaatgaaagaattatttttatttatcttcacttatttcttctctaatgctctttgtttctttagtatgtagatccaagtttctaacctgtatcatttttcttatctcaataacttcttttaacatttctcacaaagcagatctactggccacagaatgcctcaattttcatttgtctgagaaaaccttatttctccttcacttttgaaagataattttgtagggtacagaattctaggttgtaggttttttcccctcaaagtgaaatatttcattccactcttttcttctttgtatggtatctgagaagaagtcagatgtaattcttatcattattacttaaaagattgcttctgttcctttctctcttctccttcccttctttccttctctgtatattacaccttttatagttgccccatatttcttagatattatgttttggttttcttctgtgtttttttctttgattctcagttttagaagtctctatttatatatctgcaatcgcagggattctttcctctgccatgtccagtctactaataagcccttacagacattgttgacttctgttccagtgtttttgatctctagcatttctctgattatttcttggaattgccatctgtctacttacattaccaacctattcttgtgtgttgtcttatcatagtaattgcagttgttttaatttcataggtattgtaatttcaacatctctaccatatttgacattgattctgatgcttgctctgtcttatcaagctatgtttttgtcttttagtgtgacttctaattttttgttgaaagccaggcatgatgtactgagtgaaagaaactcaatacattgtaatgtgacgataagagttcaggggaagtgaagcattctatagtcctatagcaggtctcggccttttagtgagcctgtgcctatgaacggtgactttcaacaagtgcttttcattccactcttttcctgtccttaagtgggacaagatcactgggggggggctagaattgggtatttcccttctccaatgtagaagctaaagagagggctggagttgggtatttttcttcccctgtatggaaagctagaggcagttaaatttggatattttccttcttctaattcagttaggctgcgacaaaaatcccgacagtttaggctctaatattataaaataatttctcttgagtataggccttattaagaacactatactctgatggagctgagggggagttttctctgatattcactgcgagaacctcgtagagctccaggaagcaaaactcacaaaagtgtgggagtcttccagaatttttcctttgcagacttatctgcactgaacctccagaaattcatcaattacagttcaggttttcctacccaggtactggttttcatggaggtttctgcctgtgcatttctgctccagtaagttgttcttcttgtatggtctgtctttcaaattttttaagtagggttatgacctgtcgcctcacttctctgacagttctgagagtgttgatttttcagtttgcttagatttttacttgtttttaggatgaagtgacaatttccaagctcctccctgacatgccagatcagaaactgaaagtcctaagcctcatattctgtgcgtgggtatgttcacatcctgcctgctccagtgcccccacctcacactctctttcccttccttgtccccttgtgagatttctaggtccaatacaaagactgtgttcaactcattcaactacttggctcatctgagtattataatgaacaatcacaaaaaaaaatgaagtaaaagaaaaatccatcaaagaattgagatatttgagaaaaagaaaggagatcagtgttttataaaacttagaaatagattttttaagtgtttcttcattgacttatgtgaaaggacttttcttaatttaacaaattatgtgctttcgtttatagcctcaaaacttcttgtgtagctaagaatgggtaaataatcaggctttactaaaggactaacgtaaagatcttctgtaagtaacatttctgctactcaaggaagagataaacttcatggcataaccttgccaaagtatactaagaataaccctgacacaaagctcttttttcagccaacatgccatgaaagaaagaagacaaggggtgatctccactctctaagtgaaccactaaacccaccaaagaagaaacgagggaaatagaaagaggacccttgcctgagataatggatctgtatgtatgagtagtagaaccctgctcaaagtacaaggaagggaaaaaaaagttagtttatttggaattttggacattaagagtctttattgttcattttcttttaactcacatgaatggcttatcacttcaattaataaatatttcatttcttttcaatctatattcatgaaacaaatctgaaatgaacagtgcaacatgtgaatgtttagaacattataaaattaaacacaaaatctgtctggcaatcttcctagcatcttaggaaaaaagttgacaaaatttcaagcagcagaagggggcagtaaaactcaacagaaagctctggaagatttttaagattcttccttattttcttttcatgtagagtatttcccaacaaatttcagacgctaatagaaattttgtacaacagatccatatatttgcctaaaatagacacagaaacattgatatatgcaaacatgagagctataagttttacatgatcaaaaccttttttttatggtacacaatagtcacagtacttttccatataaaacaggtttagtggtcttaatttagtttggcacatttaatacactcccatgaccagcatcccaaatgtacctatccgttttattttattgtctcagaattgtcagttatttaataaattatgtaacttttttccttatgctcagatttgcacttctttctaaaactctgcccatccttaaagtcccagattctccttgaacttttttttttgactttccaagtacatggaactcttcactctatcctgctatataagtgacagaatttccactatgggatagatggagttcaattcctttgagtttaaaataatctaaatataattattccttatgccctgtttttccctcacttttgtatccaaatctcttttcagacaacagaacaattaatgtctgataaggaagacaatgatgatgatcacttcaaaataagcttgaattcaggattgtaatgtaaaattttagtactctctcacagtatggattctaacatggcttctaacccaaactaacattagtagctctaactataaacttcaaatttcagtagatgcaacctactcctttaaaatgaaacagaagattgaaattattaaattatcaaaaagaaaatgatccacgctcttagttgaaatttcatgtaagattccatgcaataaataggagtgccataaatggaatgatgaaatatgactagaggaggagaaaggcttcctagatgagatggaattttagtcatccgtgtctcatgaagaatcagatgtgtacactaagcaaaacagttaaaaaaaaaacctccaagtgagtctcttatttatttttttcttataagacttctacaaattgaggtacctggtgtagttttatttcaggttttatgctgtcattttcctgtaatgctaaggacttaggacataactgaattttctattttccacttcttttctggtgtgtgtgtatatatatatgtatatatacacacacacatatacatatatatatttttagtatctcaccctcacatgctcctccctgagcactacccatgatagatgttaaacaaaagcaaagatgaaattccaactgttaaaatctcccttccatctaattaattcctcatccaactatgttccaaaacgagaatagaaaattagccccaataagcccaggcaactgaaaagtaaatgctatgttgtactttgatccatggtcacaactcataatcttggaaaagtggacagaaaagacaaaagagtgaactttaaaactcgaatttattttaccagtatctcctatgaagggctagtaaccaaaataatccacgcatcagggagagaaatgccttaaggcatacgttttggacatttagcgtccctgcaaattctggccatcgccgcttcctttgtccatcagaaggcaggaaactttatattggtgacccgtggagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtcctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaatttgtggggggtacgaaaaggcggaaagaaacagtcatttcgtcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctaccccccgcgccgcgccctgcccgaagctt

SEQ ID NO: 54 - DNA, 19 bp, artificial sequence
  PTGS2 forward primer
cggaagcgttcgggtaaag

SEQ ID NO: 55 - DNA, 18 bp, artificial sequence
  PTGS2 reverse primer
aattccaccgccccaaac

SEQ ID NO: 56 - DNA, 29 bp, artificial sequence
  PTGS2 probe oligo (6FAM--BHQ-1 format)
tttccgccaaatatcttttcttcttcgca

SEQ ID NO: 57 - DNA, 57000 bp, Homo sapiens
  misc_feature (549)..(696): amplicon location
caggaggctgtcctctaaaatacaggagtccaggggaccaactgggaaggtgtgggagggggagggagggagccccatagacacaggggagtgaaccacgttcactttgtcagtttttgatggcagctcgtatatactatttttttctccctcctgcccccagcccctcccagaaggagacttaatctgtcgctcaggctggagtgcagtagggtgatctcgactcactgcaacctccgcctcccaggttcaagtgattctcctgacttaacctccagagtagctaggattacaggcacccgccaccatgcctggctaatttttgtattttttttttttgtagagacggggtttcgccatgttggccaggctagtctcaaactcctgactttaagtgatccgcctgctttggcctcccaaagtgttgggattacaggcgtgagccactgcgccaggcctacaatttcattattaaaacaattccactgtaaaagaattagcttaggcctagacggaatgggcttcatgagctccttcccttccccctgcaaggtcacggtggccaccccgtgagccactgttgtcacggccaagcctttttccggccatctctcactatgaatcacttctgcagtgagtacagtatttaccctggcgggagggcctctcagatatgagtaggacctggattaaggtcaggttggaggagactcccatgggaaagagggactttctgaatctcagatccctcagccaagatgacctcaccacatgtcgtctctgtctatcagcaaatccttccatgtagcttgaccatgtctaggaaacacctttgataaaaatcagtggagattattgtctcagaggatccccgggcctccttaggcaaatgttatctaacgctctttaagcaaacagagcctgccctataaaatccggggctcgggcggcctctcatccctgactcggggtcgcctttggagcagagaggaggcaatggccaccatggagaacaaggtgatctgcgccctggtcctggtgtccatgctggccctcggcaccctggccgaggcccagacaggtaaggcgtgcttcttcctgctctgtggggccacagccagctctggcagcctccgccaggagccactgttttacatacatatttttgagcacctgttttgtgccaggtgctgttctaggcccttaaaagtatatccaatttacaggatcggcaaaagcaggtggagagtaactcagggtggcagggcccccggagaccttcgagaagtgcgacgaggagggggctgccttcagtcggggctgttttcctgtgttaggaagactatacaatcctcccaagtgtcatgtttcaaagaggaagtgttggcgtggggtctcagaatagtgcttttgactgttcatgccaacatctcccccaggggcagaccctcccaaggcccatccagataggcccaaatgccggtcccagtgatggccacctgggagaccctctcccacaggcccgaatgcccgtcccagtggtggccaactgggagaccctctcctacaggttcctgggctcccctgggatccatgctctgggagtcaaagccacctctctcatgagtgcgtggctggcaacccatattccctggtgttgtcaagtggatcggttgccctgggtccttctagggagtggaggaggaggccattcttgcttccttgggaagtgtttgcatctcaactcctttacctgcagaatggatcaacggtctgccctagggctgtcaggaaatgctgtgtggcagcatctgcgacttgcactttgccagctgtggggagctgaataacttatttgccgttattaggtacagtttcaaggtgggggcaggagaaagggctttctacgtttccaaagcaagggtttccagagaggcctgaagagggagcgcccagtggtgctgtccgtgcccccactgccctccagccacctcttgatctctgctgtggggtaccgggcctgaggggtgggcttgggcagcgtagaagagcagccagcattgggctgcagtgggaagacccccaagcccatggcagggagcgggggagctttggaacccgagagaggaagtggcctcggtgtacagaacgaactgggtgggtccccgtgctggccacccccaggcccatctgcctgcgcccttgcccccaccccagcccccagctctgccccctgtgctgtgggatcacagaggccgtggcaaactcccctccccaccccacacaccctctggctcaaggctcagagcgtctttgcgggtcactcaggtccatgatcctgttacaactgaaatctagaaaattgtgattacagtttagtgcattcgtgtgtggaaaccatttccatttatttccatcatgcgacaaagacaaagcgggtgggcaagacagagtctgccggaggcagagcaccggggctggaaatcttcctccctgaggaggaaacccccccgacccccaggatgatgatcctccctcaccacggggcctctcttgacccccacagtgtcccgggggtgggcgatgatcaccttcacgtcgcgatggatccagaccccaggagggcaaggttcccatggaagctgctgggcagcgggagctgaacacggatccttcccagcaagccaggaacactttctccaaagacatctcgaggcagtccctgatagcaaagcagacaagagaacagcccctctcggcctcccctggggcgccctcacctgagccagtgtggccagactgagttcctcccctcctatgccccaaggcagggacagggaccggagggtgctctgggctcctctttcaccccctgctgcaggctgtcaaccaccagatcctaataggttgctttctgagacctttgattccgcggagctcagagcctgaagctctggtgttagaacctcttgcataagatcctgcggcagcccccagccagccccatctgtccacgtgtcttcctcctctagatccctttcctcactgccctgcttcaagctgtttcacagcttgtaccctctgtcggctcctcctagaccaccccacccggtcctctcaccttacctgcaatgggtttccacctcctgaacacacctgggtctctggaatggcctttgcccatgcggctccatcttcacctggtgaacctcctcctgcagggagcccccctgctttgttcaacctgcttgtcattggcctctccggggagtgccctacccccgtggttaccctgggcaccctgggacgatggccttgcgttgtctcgcacatgttcttgcctttctcctccatcagatccttagactcttttttttttttttttgagatggagtcttgctctgtcactcaggctggagtgcaatggtgcgatcttggctcactacaacctctgcctcctgggttcaagtgattctcctgcctcagcctcccaagtagctgggattacagacgtgtgccacaatgcccgcctaattttttgtatttttagtagagatggggcttcaccattttggtcaggctggtcttgaactcctgacctcaagtgattcacctccttcagcctcccaaagtgctgggattacaggcatgagcctgggcccagatatttagactcttattaatgacttctctggttttaatttctgggtctctctcacctggcacagtgcctggcttttgccatgctagctcccacttctcatgcacacaaatggtgctcagtaaatatttatgtattgagtaaaatttaataatcatttgttgaaattaaaaagtgaataaataagttacctagaaagatgcaaagtccacaaacctggggcaccttgcattttccctgagcgtaatgtttgcacatcaggatgtgaggaccacgtctccctctcatgtcctgagggttttatatccgcctcactggacagttgctgatgtcattggagaaggaagctggatgggtgtgtgcatgataacatcaaggaattcagcccacaacttactttgcttcttacctgtgcactttcagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaaggtatggcctttttatacgatgggttctgaagatttagaattagttagaaaagtcatttaagactacagaggctctgatcagcatcaccagctatgcctttacacagagtcacggccgccagtggtggtgcaatggggtagcctgagtcaggctgcattcaggtccaggaatagaaaggcagggctaagggacttgggaagaaacctgatttccccccggcttctcttcacatctctaaccaaaagcctgggaagagccactgttggtaacgctttctagcttgcctaggatagagggggaaggcatgacgaaatctgaagacatttcatgtattctttttttttttttttttttgaaatggagtctcgctccgttgcccctgagctggagtgcaatggtgcgatcttggctcactgcaatctctgcctcctgagttcaacctcagcttcctagtagctgagattacaggtgtgtgccactacgcccagctaaattttttttgtatttttagtatagacggggtttcaccatgttggccagaccggtcttgaactcttgacctcaggtgatctgcccgcctcagcctcccagagagctgggattacaggcgtgagccaccgtgcccggctgacagttcatgttttctaaagaatgtgcctatggatactttaaagtaaaaactctgtaattgtttaaatgtgaaagaaaatgtttatcctcactaaagcatctctttctccctccccctcacccctgtagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaatctgtgctgttcattcttttaaagaatatgaatgattttcctttctttgaaagtgaagcgcagcgtttcaccctgggctctcgcagaggttctgcatcttctgggcttcctgagctgggatacaagtgggcagctgagtgcagaaagcagggatggtggggtgtacagtaggacagtggggtgtgcagtaggacagtggggtgtgcagtaggacggtggggtgtacagtaggacagtggggtgtgcagtaggacggtggggtgtgcagcgggacggtggggtgtgcagcaggacgcaagtccaagacgcactcttgtccaggcatgaaaatggacaccgactcccctggcatttcttaactactcactgcggatgccccagcgaccaagtgacacaagttagctttccgtttatttgctttcccaaatagaaattggcgtaggagatgaaacctgtagcagaatgtctgaaagcatgtgtaataaaaattgcagagggtggcatggactgacccctccaggaaaacccctccccaacctcagatctgaacgaactagaaaatagaacagcagaggagggatacagaagccaaaatgtcactttattcccactggcccctctgtagcttggcaaggattgggagagggtgtccccccaacctagtcgtccttgctctggggacctcagctcagcaagccccaagctaaatgcaccctgggttcctcctcctcccacctgtccctccatctggtgctcttgtgctgggcacacgttgcacagttatactggagatgggatcccccgggagctctggaaagctcctgctctctgcagccagacggttccagggaggaagagggaggtgcagaactgagcggggccagctctttccacattaaccagtctggcaaatcattcccaaacccttggctaccacgttcagcagataaagaggcctgagaggccgggagacacccaccaagaagaaccatcaggaacgggaagccccctgccccctgcacacagcagcacacacatgagccgtaataatacatatgtcacgtatgtgtcaggggggccacagacacctcctcttacctctcagatgtgcaaggaagttttagcttttcttttccatctatggtatgtctgatcttacactctctgtctgctaattacaggtaaaaatgagctaactttatttagtccaattcctcttaaaattcagtttgtcataataatttgcacagcttctgtcagtcacagtctttgggaacgcattgctcagtctcttacctcgctctactccgtcttgccctctctacccctgggtggggtgaaggagcccctggggtctgcccatgccctttggattcctgctggctcactgtggagcagaagctgggggttctcagagcccagctggtgtgtggcctgtccgttcttcccacagttctccagtgtcagaaaggtgggctttccacacaacatctcgtagctgactgtttcctggctgtccaccatccgttctttcttacctaacttgcactctacgaaggaagggggagaaagaattcactttcccagcccctcttttagccagaagtggccgtgcaattctatgtggcccatgagacatagggggcatctccttgaaggtggggcaggcttctcccttgatgaatgaagagcgccctctggcttcctaggccagcccttgcagcctgcctttgggtgttgtggaaggtgggtgtgatgtggtgttgcaggcagccattatgtaataatgaggtaaggcccaagacctagagccttaataaccctgagctactgatttgagccccccacccaccttgagacatcatgttaaataaacctaagtgtgcttgtgggttaaatcacttctggtttggtttcctgtggcatttcagtatattaccaaggcccatatcttccatctaccacagagcagtgagcctatggcccagccacgatggccaggaacaaccgctctcaccaaggactgtaggcagagccagttaacaaggtgggtcactgccttcctgtggtttccctgggcctccactcagtggagcctgggcaacagggcaaaactctgtttctactaaaaatacaaaaactcgctgagtgtgtggtacatgcctgtagtcccagttactagggaggctgaagtggaaggatttcttgagcccaggaggtggaggctgcagtgagtcgagactgtgctactgcactccagcctgggcgacagagtgagacactgtcttaaaaaaaaaaataaaaagcacccttccacttcagatctgctcaatggagttacatgtcagtttacacttttcttgtaagctgctccttggcttgcaagcagcacccttgtgctgcctcttcccatgcttgtctgtctgtgtgtctggggtctgtgtgtccaaatgtcctcttctcataaggacaccagtcaggtcggattagggcccaccctaacaaccccattttaacttgataaaagaaaaacttgggcagacgtggtggctcatgcctgtaatcccagcactttgggaggctgaggcgggcagatcacctgaggtcaggagttcgagacctgcctgaccaacatggagaaaccccatctactaaaaatacaaaatttcccgcgtgtggtggcacattcccataatcccagctactcggagactgaggcaggagaattgcttgaacccgggaagcggaggttgtcgtgagctgagattgtgccactgcactccagcctgggcaacaagagtgaaactccctctcaaaaaaaaaaagaaaagaaaagaaaagaaaaaaaaagaaaagaaaagaaaagaaaagaaaagaaaaacttcagctgaattacatttaaagaagtttaattgagcaaagaactattcacgaatcgggtagcctgctgagtcagagtaggcttagactccagcacagtcacggggtggaagcagatttatggacagagacaggaaagtgaggcacagaaaatggatatgaggcacaaaaacagcccgactggttacagctccgcctttgcctcacttgaacgcagttcggactgttggctgcatttgattggtcagaactcggtgactggcacctcagttcggacagttggctgcatttgattggtcagaactcggtgattggcacaagtgtaggctacggtcggtttacgcctccacctgttacagttcacgatgtacagagaaacctttagtccaaatttaaaatatgtaagggggaagctttaggctaaacttgatttcacaattttaatcacctctttaaaggcgccttctccagatgtgatcccattctgaggcgctgggggttccggcttcaacatagaagaacagagttgggccgtaacagtggtatctgttacctgcaaccaaggagccctggcccatgcagattattacagagtgctgtcaccactgtgtgagataaggcaattctgctgtgggaggcaagaaaacaaagtggattttgggaaactggaggtatgtcaggtgcatatgggggcacacattcataaggagtattcaaggtggacagtgaaagagtggtcttctgtgagatatgctgtgtgatgagaaggatggaaccaacaagaacgtcattagggagagaaaaggatgagaaggccgcatcacagggaaccgatggtgtgctctaggctgacaactccttcagccctgaaccagcagctcacggtgaccacccaccctgcgcttggccccggaaatgcgcagtaaacatgggctgctctgtggatcgtgcggggctgcagctgagctcacaagccctcccccagaatctcttagacaaagcaagagcatgtgttagccccaggctccctccacctcctggtccccagctgagatgtccattactatgaccctggtggagaaggtggagagacggagaggatgcgtgagttcctcgtggccagaattcaggcatgtggtccttctaccctcccacacctgtatgaggtgttcaccttctctttcccttcatttttcactacgtgctgtcaatcgatttaataaatagcaggtttcacaccttaatttggtctatgcacacctctgttctgccactggctatgtactcggaggccacagttgcttctagataatttcctacacaacagggttctgttcagggcatttattgaactaaaggtcagaccaggaactaattctcgaaggcaagctgtggcttaagttcatatttgtagggtcactgggaaagatatcgttaacttaagaaaactccctcacctttctttgcaagtagagggaggggtggtttgttgcaatatttaatttttatgagtctgataggaaacatcagctcataagaaagagacacacacctggcaaatcccagtccttgtaacttaccagaaggaagggatggccattaggaagaaggggttccctgacttaaaggtccaagtagacagaagacaccagttggtaacacaagaataaatagtattatttttaaaggatttctgacttgttcttttcagctcttaacagtgccctgagctggacatttttgaggtagcaaacagactaaattagaccaaaccatacatgcccacacatgcacgtgctacaaggggactcagtgaagctaaaggcaagtattggaaggattttctacatttcatctgatctagtctatcagtgtcgagaagtgggaagggctgagcttattatatcctacgtgcaagccagcaggtgagtctgccagtttcctgtttgctagcagaagacaggagattcctggttcaaagataaatgactttattactcatgctacagcaagcagcatgaagaaaggttacttgtgttggttctctttgcctccaagacccccaagggactgggaccaggaatgggctcagatgggtgcctgcacacacagtgggttgccttataggagagaagccctggacttagggatccaagtgttttataagggacagtgagcttgcctgctctttgcttcagagggagacactttatccactttccaagattgtttgtgacccaaacatccttggagagatagtctggaagaaagaactgttttaattgcctcccatgcatttcgttagtgagggagggatttcaccctaggatgatgggatgactgaacacgccatccccaacacaacataggtgagaacaatagcagtttgtgagtcccatatccttatagctcaggggctgaggacactgtgccatgtggagccacacagaggtggcattcaggagcagagtgaataagcaaaggctgcggaaagcaggctttgtagtatcaagagggcgtagtggctagtggttctcccaggaggatgcaattggcttgtttaaataattctgtgggctggcagaaaactgaaatctgctactcacggataagcaagcacggtgcctgatcccttgacagggagggttgtttggctaggggaccttatccacgagtagagatgggaggggaactttcggtgaggctgcttgaggccctctctgtttcaccagatgtcaaggcagtacttaatattgtgccttaagtttaggtcttatgccataaggatagttagtttcttattcacaggatgtgcagaaatgtgagaactttatggagaactgtctcccaacaaccagtatactaaatatcttaatttcaggacaagattatagagggaggaaaaaggattaaggctcacaaggctcatttctgtaacattttcttaagaaaaatagaatacaaatatttccctccattgttatttttaaattttatttttagacagcttaaggctacaatataggggtatgtgcaacctctcctgagttcaagtgattcttctgcttcagcctcctaagtagctgggattgcaagcatgagctaccatgcctgactaattattgtatttttagtagagatggaatttcaccatgttggccaggctgttcctgacctcaggtgatctgcccacctaggcctccctaagtgctgggattgtggcgtgagccactgcaaccagcctggatttttttaaacggctagatagtaaatattgtaggttttggaggccttacagtctttgtcacaatgaatcaactctgcaattgttctgaaagcatattttcagagtatagaacttttccctagcacttacacatgttatcccattgtcttctggtttgcattatcagataaaaagaaatacttgatcaagaatgagtgttgagtaaataatactgtgttatcagtcattattgttattatgttctcctccatgctgtatgtctttgtcttagcctattttctgttgctaagttgaaactggtcatttataagaaatgaacttcatctcttacagttctggagactgggatgtccaaggttgaggggttgtatctcttgagcgccttcttgctggtggggactctcagatgtgtcccaaggcagcccagggtattccatggtgagggcgctgagtgtgttcatgtcctagcacaggtctctcttcttataaagccaccaggtccccttccacaataacccatgaatccatcatcccatgaatccattaattcatgagtggattaattcattcatgagagcagagctctcacgatccaatcacctgttaaaggccccacctctcaatacggccacattggggattaagtttcgacatgagtttggagggacattcaaattatagaagtcttttcctccagctgctttaagagttttttaaatcaccggattttcaacagacgaatcatgctgtgccttgatgtgatatttttggtatttatcttccttgaagttctttgagcctctaagatttgtaggtttatacttttcaccaacttcagaaaaatctaatgaatatttactcaatactcattcttgatcaagtatttctttaaaagatttttttctctcctctcctactggtacatcaattacatgtatgttagattgcttgacattgtctcaccggtcattggaatcttgtttatttgtttagccctttttcactttatgctctagttcgcatagtttatcttgcactggcttcacttcaagtaaactgaccattcctctgcagcatctaatagtatctaatcaaaaacccatacagtgtatttttcatttcagatgttgtattttttatttctaaaatttgtacctggttaatttttagtttccatttatctactgagattcctttttgttcctttattatattatgtttttctttcaatctttgaacattttatgccatgtctaagtctgtttttgttcactgatttttctaatgattatgggccatatttcctagttctctccacacatctagtaacttctgattttctgttagacgttagggatgttatgttgtgtatttaggttttgctgtcttcattagtaaagtgttgaatgctttgctctctcaggtagtgttatcggttgaattatttcccccaaattcatatatgaagccttaaattccattacctaagaatgtgactacatttggagacagtgtcttaaaaggggtaatcaggttaaaatgaggctcttagggtgggccctggttcaatttgactggtgtccttataagaaaagagtcgccagagatgtgcgtgcacagaggaaagaccatgtgagatatggggaaaaaaagccatctgcaagcagaaagaggcctcagtagaaaccagatgtgctgacaccctatcttggacttctgggcaccagaattgtgagaaagtacacttctgttggttaagctacacaatgtgtagtattttgttacagcaacctgagtgaactaatacaagcagttaatttacttgcaggttaacttgattcctgcaagacttgttttaaagttttgttcgaatggattttgagtagctttcctctagaaagatcagccttctttttacggcatggcctttattgaatgcttgaagtggtcaacacctctggctgctctgagctcaaatgctttccagccccacgaaccctacactagttgttcagtttagcctccccagtgattgttctgtccccaggggctacttagcctggccttgtgggcacgaacagcatagtatttgatgaaaagctcaaaggacacacttttatatttctggagcttccttctcttaccttgataacccgcctgcctcagaagcttccaattctgacctctgtctcctcagcccgatgggacttcagtgctatttgggttcccctccctgtgctgtagtctggagagcgtctccaggaaaccaaggcagccatgggactccccctattgtttcccttctctcagggatcgctgtctggcactgcctgctgctcagcatctgcagactgttacttatgtagttttagagttactcatggtgggaggctagcctggtaccagtgactccatagtcaaaagcggaagtccacatgggtgatagctgaggtggttcccatttgttgactttctatgtgaactgatggaaagtatcatccccaaagtgtgcaaaatggaagtgagcaggggtggagaaggataaacagaaagaggagggcgccagccctgagtgcctggatggcgctgagatcatgcgttgagagtggcaacaattcaaggtaggtgtcggccatgctaggcagatggcataggcacagagacagtgggaaacagcagtgaggaagacggtgggtgaagtgagcactgtggaaatcaggctggagaagcaggaaggaaggatagacaggagggggctcacaggggaataggggattggagggctttaggattcagacaaagggagaatgttaggagcttaggacatcctgggcagaaaggacatttgcataccctctttcagaggtggagctcaagttctgagtgtggtcatgggagggtggcagaagtggcagaagtggagtggagatggaagttcctagagatgaggaaaaataaaatctgagcgactgtgaattttgatgaaacatcgaccgccatgttgaagatggctgggatgtggccaagtcttagcatgacaaggaacacagtgaactcagtgctgaaattcttaacgaaagggacaggctgcacaaaggtcggcagatgacagcagggcagggactccggacatggcgcccttcccagcctgcatctccaaggaggatggtttttgcatgagggtgaagacttggggctcaaagtcaatgtccagcccccagtctgagcccatgtgatggggacgtggccaccaagtacagttgtggaggttgtgaacagctccactttcaactagcgatgccactctattgcagacgtcccatctcgtgtaatggtttcccaactctgtgggcactcagtgtccctgcgtgggggcctgagcaggattccagggaagcatgcctatgacaacacaggcttccgccagggccaggagagtgagagaggctgagaagtggtctcttttgcatgggtcaggtggtcgcagcaggaatcctgaaggggctgcagtgagcggtgggaagtcgagttgatggggaggaagcagagaggagaggtgggtgggaatatgagagaaaacaatgactcagtcacttatatcatgatggtgactaaagtgacagggatgtagaacaaggaaactgaccttgccagagttttcatggatcgagtccctgtggttgcccagtggtgaacagtcagcagagagcctggaggtacttgacccggacccagaggagccctggaggatggagcctggaggacgggggcctggagaatgagggtctggaggacgagggtctggaggaacaggggcctggaggacgagggtctggaggaagagggcctggaggacaggggcctgaaagatgggggcctggaggatgagggtctggaggatgagggtctggaggagcaggggcctggaggatgagggcctggaggacaagagcctggaggacaggggcctgaaagatgggggcctggaggatggggcctggaggatgggggcctggaggacgggggcctggaggatgatggcctgaaggatgaaacctggaggatggagcctggaggatggagcctggaggatgagggcctagaggatgggggcctggaggacaggggcctagaggatggagccctggagaatgggggcctggaggatggagcctgggggacgagggcctggaggatgggggcctggagtatggggcctgctctccagaccctgaggacagccccgtggtggaccaaggattttgggtttcctgcgtctctgggcccctgactgctcaaccatcagaaacagactggcaaccccctgtcatttccctggcgtggggaacttcgggtcccctctgtccttcccaccacacttttccctctttctttccgggtgtctactctctggcttctgtcttctctgtcaggtccacagaatccttctccagcacatcctaccccaggaaggccatgggctgggtcccaggtgccatctttcagaagatgtagagcattcccatggaacaaaaataacccatttcaggggttggctgaaaatgaacttattaaaacctgcctgtcacaggctactccgctgaccctgtcagcctcatctccatggagagcagcccctcctgctgaagatgggacaaagggcatcgtgctgcggttggggaggctctaaccacagccctgggagcagtctcttacctcctctgagatgcttcccttcctcagggaggggacttttccatgctatctgctggcctgtacattttccccagtaaacttggccctaatattttctaaattcctgtggtccctgcccactctatcaatagaaatgcatagcttatcccttcctgggtgtgaccctgtgtgtgcccagccccagacctgcacgtggccggttttccacgctggcagcctggcatgacccaactctctgtccagggcaggaagaggtatcaccgagcagggagagagtcaccctggcccggaagcctcgcctgcacagggcacagctgcctcttgcctcctcttcgcctccacggtggaagggctggggccacggggcagagaagaaaggttatctctgcttgttggacaaacagaggggagattataaaacatacccggcagtggacaccatgcattctgcaagccaccctggggtgcagctgagctagacatgggacggcgagacgcccagctcctggcagcgctcctcgtcctggggctatgtgccctggcggggagtgagaaaccctgtaagtgaaggagagggtctttttatgtgctttctttatttctcttaaagaaaaaaaaaaagcacaaccataaattaacttgagagggggaatggctataaaggcatctggcaatgtgtgttgttcacatgggatttgccactgctcaggagggtggctccaagaagggcctccctcctagggaaaggctgagtgacggcaggtgtcagcgggccccgtgtcgggccaggagggcattcccaccaagggtccttggagtcccagagcactcacctctcgcctggatcttggccttgggtccatctgttcaccctcctctaggagggttttgtttttgtttttttccgagacaggatctggctttgccgcccaggcaggagtgcagtggtgtgatcttggctcactgcaacctctgcctcccaggctcaagtgatcctcccacctcagccgcctgagtagctgaaaccacagttgtggaccatcatgcccggccaatttttttttttgtattgtttgtagagatggggtttcgacatgttgcccaggatggtcttgaactcctgagctcaagcaatctgcccgcctcggcttcctaaagtgctgggattataggtatgagccaccatgcctggcttttttttttttttccttttaaactaatataacaatttcagcaaagccctatcggcttctcaggaggaaaccgcattgcttaaatatgggcaagataagactttgtgtttctctatgtggcaacaagacagtagaggcatcccctagaacctctgagagaaggagcagtgtggtctggggtaccagggtggggccgactgagggtctttccacagccccctgccagtgctccaggctgagcccccataacaggacgaactgcggcttccctggaatcaccagtgaccagtgttttgacaatggatgctgtttcgactccagtgtcactggggtcccctggtgtttccaccccctcccaaagcaaggtaatcttccagggaatcttcctgggccagcagctggcaacccaggacccagcttcacaggcggagcccagagcaggggccggaggaggcccagttgctagtctagggttagcctgggtgggttagtctcgagctagccccggttggttagtctggggctagcccaggttggttagtctagagctagcccaggttggttagtctggggctagcccaggttggttagtctggggctagcccaggttggttagtctagggctagtgtaggctagttagtctaaggctagcccaggttggttagtttggagctagcgcaggttggttagtctggggctagtagcccaggttggttagcctggagctagcccaggttggttagtctagggctagcgtaggctggttagtctggggctagcccaggttggttagtctggagctagcccaggttggttagtctggggctagtagcccaggttggttagtctggggctagcccaggttggttagtctagggctagtgtaggctagttagtctagggctagcccaggttagttagtttggagctagcacaggttgattagtctggggctagtagcctaggttggttagtctggagctagcccaagttggttagtctagggctagcataggctggttagtctggggctagtagcctaggtttgttagtctggagctagcccaggttggttagtctagggctagcgtaggctggttagtctagggctagcccaggttggttaatcggagctagcccaggttggttagtctggagctagcccaggttggttagtctgaggctagtagcccaggttggttagtctggggctagcccaggtttgttagtctggagctagcccaggttgtttagtctggagctagcccaggttggttagtctgggactagcctggactgctagtctagaggtagcctagaggactgctagtctagaggtagtctagggctagcccaggttggttagtctggggctagcccatgttggttagtcttagactagcctggactgctagtctagaggtagcccaggttgtttagtctggtactagcctggactgttagtctagaggtagcccaggttggttaggttggttagtctgggactagtctggactgttagtctagaggtagcccaggttggttagtctgggactagcctggactgttagtctagaggtagcccagattggttagtctgggactagtctggactgctagtctagaggtagcccaggttggttagcctggggccagcctggactgttagtctagaggtaacccaggtcagccaacagtgagatgaaaatttcccacctaccctgtttctacactgttagttctttcaacagacatgtgtgtgtggagccatcagttttactttagttgagaaaaaaatatatatatatatagtaggtctcctctagtttttgaagtgtgacttctgaagaagcttccatggggaaatgaaggtatttaataggacagcagtaacataagggctgacagccctcaaatgttagggaaggaagtgaagccttctagggttctttgggagtgagttttatgttagtgcacgggatcaggacccaagttgtaacgccgacgagtgctcaaaggaaggttgtgtgtgtgtcgtgcacctgtgtgcgtggaaccaggcacgtcctctggagaaggaggattcatccccaagattgttgctgggaggcttgctgggccccgcagggaaaccaggcagatggtggattgttcacgagcgcccactgaatggcagtgtctttgggaatcaataccatgtccaaacgctttccatcttaccaaggtgcccacaaaccttttctcatcttggcccgggggaccaccccatttactgagaacactgagtcccgagaggcaaaatgatttccccaaggcgggggactccagagcttctgactgtgaccaccccacatgggccccaccttcgcggaggacaggccagccaagcgtcgctggggccgacacttccacagtccccgggggaggcggtcccaggggccgacacttccacagtccccgggggaggccgtcccgggggatgctgccccaggcagcacctcatgatccacggaggctgcaaatcagcgctgctctcagaggaggaaggggtggagctttccagggcacagcaggcctgactgggtctcggtgctgtgcctgtcccatggcagagtcggatcagtgcgtcatggaggtctcagaccgaagaaactgtggctacccgggcatcagccccgaggaatgcgcctctcggaagtgctgcttctccaacttcatctttgaagtgccctggtgcttcttcccgaagtctgtggaaggtaacgtcgctgtgggactctctgtctggttcccggacaccatgattcctcctccgtccgtagaggtggggtgcagggaggggagctgcctcgcagcctcagtgccatcgaggccagggcccctgcctcctatgggattctgaaggcaattccagaatgttcttggcaaagacagcgtcttttcaataagtttatagcctccagcattgccactgcgtcatctgtgatggctctagaaacagcggctcatccctgttgcctccccaggtgttgcaacgttcagaggcgttgcctgttttattgcaagcccatctgcatttggaggctactgagtgtcttgcactgtgctgggtaccagagagggcccaactcaagcagacctggccccttctcccgtggcttccccgttctcccccacatgaccccgaatgacaaacctcatccacaacgtcctgctccgggcagtcccgggagggtcccgccggcagaggtgaacgggtccacttctcccacccgcttagtgatagtgtgttcctgactcggagtgtggcgaggtaaaaaaagaccaagcagatccaggaaaatggggaaagagctactggcccttgaaggatgccttttcttttccttttgttaggatatcaaagcactccaaagagcgaaatatttcatgttcaggattttccgagtgattttttttatgtgacctaaaggtccacctagaaaatgttcacttgtctggggagaatgcgccccacagaggaaactctggcctggggtgggaagatttggtccctttacaccccctccccgggaaaggagctccttcttcagtaggaagctcctgggcaaagtgatgcacgcccaccccagcttcgcagcctaggcactcccatttctggggttcccttaccaaccatcttgcatttaaacttctagactgccattactaagagaggctggttccagaggatgcatctggctcaccgggtgttccgaaaccaaagaagaaacttcgccttatcagcttcatacttcatgaaatcctgggttttcttaaccatcttttcctcattttcaatggtttaacatataatttctttaaataaaacccttaaaatctgctaaatttctttttggtttcattaacacagaggtggtaatggtggtgtgcgtgtgtacacatgtatgggtgtgtgtacccatgtatgggtgtgtgtacccatgtatgggtgtgtgtatatgtgcgaatgtgcatatgtgtgagtgtatatgcagggtttttttgtgtgtgttttgagacagagtcttgctctgtcacccaggctagagtgcaatggtgcaatcttggctcactgcaacctcctcctcccaggttcaagctatcctcctgcctcagcctcccgagtagctgggattacaggtgcccaccatcacactggctaatttttgtgtttttagtagagatggggtttcaccatgttggccaggctggtctcgaactcctgacatcaagtggtcctcccaaagtggatgactttggcatcccaaagtgctgggattacaggcgtgagccaccatgcctggcagttttaatgtcccttccatttttctaagagaaaaaattcatcaaatacattcaggtttctctaaaagcaataaaaaagtattgcatgtaagaacatttcagaattcacaatcactttgtaactcccattctcagtcctttttataaaaactcaaatgactagccctaaaaacctcttggagtgatacgtgacttcagattgcaattgcaaaatcctttctctttgaccgaatgcatcgcagacccctcgattttgagacgattgtgcggcagccggtcgtctcctatttctaaggcaagcagggaggggccttgaccaggtaggccaaaaattctctcccaactctttgcttctgtgttttctggcctctgcctgagggtagctttggtaatctgctaacagttgaggatattcaagggaggaagttgacagcatttcattaaggcaatgccagccgtgcggagatcactgtgtgaaatattcttatttattcattattattattattatcgtaccaattgacagggtacgtgtgcaattttgttacatgtgtagtttgcatagtagtcaagtcagagcttttagggtgtccaccacctgaatcacgtacactgtacccattaactaacttctcatcatctgccccctacccccgtcagccatccacatgtccattgcccaccattcctctctatgtgcacgtggacacatttttagcatccacttacgagtgagaacaggtgatatttgactttctgtgtctagttcatttcacttaagataatgacctccagttccatccatgttgctgcaaaagacatgatttaattctttttatggctgaatattatttcattgtgtatacataccactttttaaatccatttgcctgttgatggacacttaggttgattccatatctttgctattgtgaatagtgctgcgataaatgtacaagtacaggtatctttttgatagaatgatttcatttcctttggatagatactcagtggggactgctgcattgaatagcagctctgtgtttagttgaaagattcttttgtgtctcctttaagaggtcctggtgtcattcagctcggtggtgggagtgcagagtggatgacgctaggccagtctttctgttgcttcccccaacatccctctcctacccgaagccaattgccttagcaaatgtgtcacccaatagcccactcctgtcaccccagaaaatccaaggcctctgccctccagggtgggttggggccagtgccactagcttcctattggaagatgggagtattaggaagtgcttcttcaaggaacggatgtggccttacatcaactctccggatgcctgctttgcgaggaggccacatgctgccttgggtctcagctgtgtctcagtcttacctacaacatatcatcagctcaatgaacagtggcccttgttagcaacacggggtctcagaaacactcaagataatcaggtggcggagacggatgctcatgtttgtgaatttatccttcccagactgccgtgtcctctctcgtttgtcccccccagtacacttagtttatgggttccagggtcagccagccctggccacactggcggaaaagccaaatcaggccagtggattcctggaaagggtggttggcatgctctccaggggcatgtgaattttctgtgcctcccgggtgaagagtgtggaggttctgctcccggagttggcactggggccttcttgggtgccggatgaggtgaaagcttctggtttcatgcctcttcgggcagtttctggtctgcagacttttgttctcaggcagttgtctgcaggccacttggcatgaggctctaggtgcaggaacgtctttaatatgtgggcacttgtgtttcccatggtgtctttctgggaactttcttctcatgctggtactccaatcccatttcctccttcagaaattctctgatccatgaaggccccagtttctgaaccagttcctacattgcccttcggatccttgagcaggcattctgaagcaacttccgttgtgtttgccatgggcctgggcttgggggtccgtgggccactctgatctgttaccgatagtacagctcctgctggctccagcactatgagtgagttaattaaccacgtgccaccacaagatagctcagagtgggccacccccttcctcctcctttggggggtccccccaggggccctggagcaacagctggtgacatttgaacccaccccttgagtaaaacaaggcttccttttcccttcgccctcttttccattttctcccccaatcattgcctccctgccccttcctcctggggtctcctgctgcttctcgtctcctctgcttgcccctggttcccttcccttctgttccctttccctgcagaggctccaataatccctatccagtgcaggcagggacctcatggatggcagagccggtgaggcttggcgggagggcccagtggccatcgacctaaccaggacagccgctgcggccctcaagtcaactgcctgccctcctggctccctgcgctcctccaggtccctgcctggctggtccaggtaacagagatggcttgagaagcaattataggagacggggtcggtcagctcgctgggggtgggaacagcaggagctgtcaccatgtgtgcaggttgatggcccaggtgggtcaccgtggggaggtttttaaaaatctctcagattctcaggctttctgtttgtaaaatatgagtaatgattacttccctagcagggttctggcgaaaattaaaaataacgtttgtggctgggcatggtggctcagtcctgtaatcccagcactttgggaagccaagagaggaggattgcttgagcccaggagttcaagaccagcctaggcaacatgctgagaccccatctctacaaaaaatacaaaaagtagctgggcacacctttagtcccagctactcaggaggctgaggtgggaggattgcttgaacccggggaagtgaaggctgcagtgagccgtgatcacaccactgcactccagcctgggtgacagagtgagatcctgtctcaaataataataataataataataataataataataataataataataataatgtttgtgagctgcctggtgcacacagcaggcccccactacatggagctcctgccagaggccgccggtggccttgtggtcttgtcctgtggcctcctataaaaaagcatcttccaaggagaatggcttgaacctgggaggcggaggttgcagtgagctgagatcacgccactgcgctccagcctggtgacagagcgagactccgtatcaaaaaaataaacaaacttcttccaagtaccatgtaggacagccagctctgcctccagaatgtggtaatcctggataacacacacttattctttatatattcactatacctagcgctcgccgcatacacagtcatgcaccacgcatgacaatgttttggtcaacagtgggcctcgtatatgactgtgatcccataaggttacaatgaagctgaaaaatttccatcacctggtgacatcagggccattgtaacgtcacagcatgacgcgttactaagctgtttgtgggaaggctggagtcaacacacctactgcactgccagttgtatgaaagtacagcacataaaatcatgtacaccacctaatactggctatgattataaatggcagtgtgactggcttatgtacatactacactttttattgttattttagagtgtactccttctacttatataaaaacagttaactgtgaacagcctcaggcgggcccttcaggaggttccagagtcaggtattgttatcataggagatgacagcttcctgcgtgttactggccctgaagaccttccagtgggacgagatgtggaggtggacgacggtggcagtgagaatcctaaccctgcgagggcctcggctaatgtgtgtttgttttagcttttaacaaaaagtctaaaaaagttaaaaaatattaaaattactaaaaagtttatagaataaggatataaagaaagaaaatatttttgtacagttgcacaatgcatttgtgttttaagcaagtattattaaaaagagtcagaattttggccaggtgtggtggctcacgcctgtaatcccagcactttgggaggccgaggcaggagatcatgaggtcaggagttcaagaccagcctgaccaacatggtaaaaccccatctctactaaaagtacaaaaattagccaggtgagttggcaggtgcctgtaatgccagctattcaggaggctgaggcaggagaattacttgaacccgggagaaagaggctgcagtgagctgagatcacaccattgcactccagcctgggccacagaatgaaactccatctcaaaaaaaaaaaaaaaagaaaaagaaaaaaaagaatttttaaaaattaaaaaaaatataaagtaaaaatgttacagtaagttgaggttaattttattattgaagaaagaatagtattttttataaatgtcgtgtgtttatgaagtctatggtaggacagtcgtgtcctgggccttcgaattcactccccactccctccctgtcttgtccggtcctgcaagctccgttcatggtaagtgcctacataccgtcccattctttatctttcacaccatgttttgactgtatcttttcttttttctttttttttttgaaaaggagtctcaccctgttgcccaggccagagtgcaatggcaccaatctcggctcactgcaacctccgcctcctgggttcaagtgattctcctgcctcaacttcccaagtagctgggattacaggcactcgccaccacacccagctaatttttgtacttttagttgagacggggtttcaccgtgttggtcagactggtctcgaactcctgacctcaggatctgcccacctcggcctcccaaagtgctggggatacaggcataagtcaccatgcccggccttggctgtaccttttctatgtttagatacacaaatgcttaccactgcgttacggttgcttccagtgttcagtccagtcactcgctgcacgggtttgcagcctgggagccaaccgtgcagcctgggtgtgcagcaggcgctgccctctagctatgcattaagcacattctacggtgttcacacaacgacaaaacccctcatgacgcgtttctcacaacatttccctgtcgttaagtgctgcacagctgtatgtgcacaggcactttagtgctgatttatagtgggtatctatacagtacgttctggcattcatgtagttaagctctatgaagtcgctgccagccctgacttagtgaatctggaaccctcgctcctggggaagtacagggtcaggtttctgcaagcttctgggagcatttcattaaccagccatatgtagccaggctcgagggtgtttcctgtagacaccttgtggagtgcacacggtggttacattaatgctgaactccaggccggcaccctgtctcccagccccagtgaggctgccctgcccctggtgttttccccagaggcatatcacctcacacccaggacaccagacagctcctcactatggcacatgggggcatcttaaatgggaaatcaccaacaacaggcataaaaacgtggcactacatagaccaagaaaaggacattagttcacagtatgggttgaggcaagaaggccttgtgtggctgggcatggtggctcatgccagtaatcccagcactttgggaggctggggcgggcggatcacaaggccaggagatcgagaccatcctggctaacacgatgaaaccctgtctttactaaaaatacaaaagttagccaggtgtggtggcaggcacctgtaatcccagctactctggaggccaagccaggagaattgcttgaacctgggtggtggaggtagaggttgtggtgagctgcgagcgcacatttgcgctccagcctgggcgaaaagagcaagactccatctcaaaaataaaaaaggccttgtgtgacttcagttgggaatatgcatgtctgtgactcaaatttgtcaccactttgtacgtttctgcaaacgaccttgaaagcaccccaagtattgatttagggtcaccaataaattttagtgagtaggcgaatttgcaaatagagaatatgtaatgggaatagactgcatattcattacatgcattttatattcattatctatagtttggagttgtggtacacgcatgaatatctctagctattgcttcaggggccagccccagtgtgatgtccccctcaacccaccctgccttagaagcccaatctgacccccaccatgggatgctgggcagttaactggagtcagggggctgcaatgagggtgtgtgaatcagatctcaaaaatatctatcgcacttcggctctacagcgatttctctctcagggtcactgtgtgaccttggacaagttacgtagactttttgaccctagttttactcatatgctaagtacagatattcataacatcttcccttctgggtttgtggtgaggcttcatgagttgaattaggatgtgcttagagctgttcttgctatgattgttcatacatgcacatcctcatatcctaggcccattcttccgggaagacacacgtggtcctggttgtctcacagtgactgtcccagtggcgggcacccggccatcagaccctcagcattccacctgctcacacaggagggccaatgcctaccaagcccctccataagcacatcggggttcctctcccaggggctcttccatggttgcctacctctgcctcacctgcctgtggccctggctaatgctgtggtcctgacacatagctatccccaccccaagctggaactctgctattgtacctctcccagaaacccctgggggcctgcccttgccagtgaaataggcaggcgtgttgccttccctcttgctgcactttgctgggtgggccacggcaaggatgcctgagccttggggcccccaggcgtggagcaagcagccgtttcttccttgtggaagcagcgtggacactgcaacccatgaggccaccatttcagggccatgcatgcaggaatatatacagcgtgtgtcttctgggtctgcagccactcggcactggctgggagggagcagccccaccttcctccagctagtggagggaccaggccacagggaggtgcagcctggccactgcgccctctcagtaactagcagcagcccaggggcctccagacaggctgggcaaggactggttcccatgtgcaggaccacagctccctgacagcctctgtctcctctgacgccccatctgtccctccagcatctgtcccgccccaccggcctattccccgagtcagcccatctctgcaacagagcttcccccacctcagccccctctcaggtctgtgtaaagagtggtgggaggttttcagcactttcctgggaactttctcagcttccagggaaaccaggggagggaggagtagccccactcccgctgaagggctctgatctcagctcctgccaggcctccagcagcgcggacacggatgagctgacaccatcgcaggacggccgccagttttccacagggcccagtggctgcagcctctgtgtttgttttctgtgatccaaagactgctcagcacttaataattgtttgacttaatgtggcgcaaccagaaatgtggcttagaggaaggaagggccctctattcaaccttccgagcgcacagggctcattaaggtgttttcccctaaagaaccctacaggctaatgatgctccacagcgccctctgctatccatgctggggacagactctcagccttcctgcagcccaatgggcaagtgggttcggcttcggcatctgacaacacgcagcttcctgatgtccagagagagatctcagtgcctatcacacgttgcaaattgccccgtcatttcatcagttcactgtgttcacattagtaacgctgatgatggcaatgctcatgccttgagatttttttaaaaattagtttctcggaggtataattcacatacaataaaactcacccattttaaatgaatcagttcattgagttttgacaaatgtatacaactgtgtaaacactaccacaatcaagatgtagaacattcattccctccaagaaaatcccgtcgtgccctttgctgtcaatagcctctccctagcgccagaaaaccaagaatctgtgtttttttgctttagtttcatttcttctagaatttcaagtaagtttaatcacacagtgcagacagtgcacagtctttgaagtctgttttctttcacacagcacacagctttctttgagattcttccaggttgttgcacagaagggtggttcgttccttttcattgctgagtagtattccacagcaggatacactgcaatatgcttacctatttaccaggtgatgacatctggattattcccagctttttactattatgggtaaagttactatgaacaattatgcacatgtatgtgaagggatttgggtaaatgcttgaggaaatgccttttttcttggaagtgtagctatgagtggatttctggatagtacggtgttatgtttaacttcataagaatctgaaaaaattgttttccaaggattgagccattttgtctccccagccacaatggaggagatttgcaaatgcttactacatccttggtttactagtcttttacattttagccattgtggtgtgtggaatgtgatatcctgttttcattttaatttacatttcactagtaactaaggatgttgaacatcttttcatgagcttatttttcacacatcttctcaggtaaagtatctgtctaaatcttcaacactttttaactcaggtgtctttttcttctttgtaatgagttgtaaaattctttatatattctgcatacaagtcctttactagatatattttgtgcaaatattttctcctagtctgtgacttaccttttcgttcatttccttaagaatatttttcaaagagaaaatatctttaattttgatgaaatctagtttttctcatttttcttttatgattcaaactttatgtttcctacctagaaatctctgcctaattcaaggccacggacgtgttctattatattctcttctaggagttttataactttggtgcttatacttttgtctatgacacattttcagttcacatttttgtataaatttgtgcattttcctttgtttttaagtgtctgaaacaatttttgcagcattgggactgttaggtacttgaagcttggctagaatttccctgtgagattatctggacatggagattcttacggcttttttttctgggaatcccgaaagaaccagcccttcaaggtggatcccggggagccaactggggctaaattcaaaatagagccgtgtggccatttgctgactagacgtcacacacgtactctgcattcctggaaacccacatgtttgcttcgttctgggacattcatagctgctcctgttcactcctgtatcaacggctactggaaagcctcccctcggcccctggagctcaccaggagaatgtggcccacatctaccaatcagaactaaacaagcgtcaactaaccacagctaagcaagtttgcatcccctatttgcatagcagacgagagtgggaacccagagggagctttctctttaaaagacaacccctctctttgttgtctcagattgcacctttgttttgtaccgaagggggtgtctccctggtttgcaaaatgtttactggaataaagtctctttcttttttaaaaaaataagcaaaatcctgtttaatgattttgttgacagctccttgataacgttttccatttcttctacggtttatttcagccctatgtctctattggacccattttgttaaactgttattttcctaggaacttacgcgtttcatctagatattaaaaattagttgcataaagttattcagggtagcctcttaccgtttttaaagactcttctgtttcaatagttgtttccttcattgtcaattcttattctggatatttgtggatccttttttcattttttttattgggttagccagtggtttgcatattttgtttaatttttaaaaataactgggattgaatttgtgaaaaagaattccactctttttctcttctgtacttcattgatttctttccctttgctttctttcagccttttttcaacaagctattcttttcctagttttctggtttgggaattcaatttatggattaatggcatgtgtttaaatctatgcactttccactaattaccattttaaatattgcccatagattcagaaatgtggtgtttttattatcataatttctaaaatattctataattttggttagtaatttatcttttagccacaagtatttaatagaagatatttccatttccatgtgcaataatgttaatattttttggttttgttgcacttgatcatagagtgattataacatttttacttttctttttttgagacagagtctctctctgttacccaggctggagtgcagtggcatgatcttggctcactgcaacctctgtcttccaggttcaaacgattctcatgcctcagtctcccaagtagctgggattaaaggcgtgcaccaccacacctggctaattttgtgtgtgtgtatttttagtagagacagggctttgccatgttgccccaggctagtcttgaacccctggcctcaagttatcatccctccttggcctcccaaagtgctgaaattacaggcctgagccactgcacccagccaaaacttttactttatggaacttattgcttttttgtgtgcaaatgtaccattaaattttgtgaatatttcatgtgtgcttgagaagaagttgtattaatattgggaattaaactttgacatatccatatgtatacatacatacacagtgtatatgtctattcatcagatctgccttattaattatattccttgagttctatttttttacttacttttttctttgttcacttgacttgtcttatcttcagaatgatgttctcatgaccagttatgggttttgtctatttctgcttgtatctcactgtttctggcttataaaataaatatacttttcctatccctttcttggtgcaaaaatatttataactgttattgctccattgtgaactgtgacctgccaagcgtctgtcttcatcatgtctgatgcctgctggcctgaattctattttgtctgatgttgagattgcagcccctgctcagctcaaggtcctagtagttacatcagttttggtcatcaagtgcttcaaagctctatgattttagcaatatattgattaatttttcatcagaatagctgttggttaacagcagaaaggaaaagaaataccagtcaagaaatgtagggggccgggcgaggtggctcacacctgtaatcctagcacttagggaggctaaggtggatggatcacttgaggtctggagtttgagaccagcctggccaacatggtgaagccctgtctctactaaaaatacaaaaattagccaggcatggtggtgtgtgcctgtaatcccagctactcgggaggctgaggcaggaggatcacttgaccctgggaagcagaggttgcagtgagctgagatcgtgccattggactccagcctaggggcaagagtgaaactgtcaaaaaaggagaaagaaagaaagaaagaaagaaagaaagaaagaaagaaagaaagaaagaaagaaagaaagaaagaaagaaagaaagaaagaaagaaagaaagaaagagagagagagaaagagagagagaaagaaagaaagagagagaaagaaagaaagagagagagggagggaggaatgaaggaaggaagagagaagagaagaaaggtgctaatgaggaagaggataagacaataataataaaaatgacaatagtgccaattcatcttatgcttttcaataggtaagttatctgatggattggcttaaaagtctcatagagcacatcaaaatttctctagaattaaaaataaggttaaaaaggaaaacaaatgaccataatctgaattattgcatttttgatgaaacgcttatctaaaataaaatagttttatatcagttcatcttatcttatgccagacaaggttactgcaaataagtttttgtaaaattccaaacaagatgggtaagatgggttcttttccctgtgaaatgtgttcacaagtcaaaaaggtttgggggccgggcgcggtggctcatgcctgtaatcccagcactttgggaggctgaggtgggcgaatcacttgaggtcgcaagttcaagaccagcctggccaacatggcaaaaccccgtctctactaaagacacaaaaattagctgagcgtggtggtgcacacctgtattcccagctactcaggaggctgaggcaggagaatcacttgaaccctggagttggaggttgcagcgagccaagatcatgccactgcactccagtctgggtgacagagtgagactctgtctcagaaaaaaaaggagtggggtgggggttgggaaatgcgatcccagtgcttgcttctgcattccttgtcactcacaataaccccatgagctttgtattatctctggatttctctgaactcacctgctttatggctgtgttcttttgcaaactgtaccttggcacattgagtgtattgaattatgaccaaataaccctcattatgtcaaataaacaagcccagggtccctgcctctcttcctgcctttgctttacctggaatctataaaagtctgatgatcagcaggcattcagcctcctttgctgaaggtttttaatcattcagccaccagagccatgccatttgctggaaaactgacttctgggctcagaggtcagcactgcactgcaaggctccaaacctgtgagcttcgggccaggtcaagatggtttattgtcttcatttacccatcccactttcacacacaccctactgcaatcaatgacttccatcctcctgcagctggggtggcagggagctgagctgagagccactcccacccaagcagaggaggctcaggagaagagctagaagggatggtgaaggcaaggatctgctccaggagtgaacagtcactctgggcatgaaacctcgagggggagacagcccaggaggctggccggtgagttaggtcaagtcaaactgaacagaatcatgagggactgattgagtatgtctacagagtttgcatcttgagacagtcacaaccactatagagtagtcattgtgtgtttacttcttataacagcaatgacatctgctaacagcaggtggacagtgcttcacccttcaggttgcactgcctaccattgcttgagcctcacacctaccttgcgagggtgggcaaggaaggcatcattattatccagcaggaaactatggctggatgtccaatgacacccacaaaacttgaattccacttttctgtctctagaccctatggggcatcacctgtcagtcttcctgtacctcagcagagatgaaagtgaaggagatcagaattgctatccccgagatatgccgctttggaataggaattattttgagatgaaggcaatgaagaagcatcaaatgcagaaagagcactttggcctccttaatctgcctcaaagcaggacataaattttcctttgtgaaggtatttcttcctctctcccctaccaggggactgaaagttggcactgagatgggtctgcacaaatgaactttactaaaataaccctcatcttccattagtttccctcagatatttaccttcccacaatttcccacctctaggactccaaatttctttcccttccccttatcacttctccataatttattacctattgttaaagtggtatataagcccctaggtgtaaccacttcttgggatcttcatttcttttctatgaaggtctctatgcacttaaaaattaaaatatcaacatcaagtttgttttctttttctcctgttaatcttcctttttaacaagtttaatttgcagagagctgaagaacctaagagggtagaggagagtgaagagcccaggtcatggccactgcaccttgggttcttgagcagctgccatctggaagtcaagtactcttctgcccaagggctgtccagggcatcatccaccatttctactctgagtctcaggactgtctggccctgccctgctgccctggagaaaggtattttcttgttgcatctccatttactatcctctttctcacctctcaagtaacacatctccattgactcagtcagatcacctctgcctggcagagccaattcagagtcttctttccctttaagacttcctctattaggagtgttgtgctaacattgaggcctaaaaccacatatttttcctccctgttgactgtatgtgtatctgtgaattgattttttaaatgaccatatttaccttctcaacccctcttaatatgttgagctgctagaggacacgacatatcgatatgaatgctgcatggatttcataatgctgggggctgagttggagtttatgatgcctccatgactgcagctttcttatcaacactgaccatatcatcttcttcttttgtaacctcccacagcacctggactgaaggctgtgcacacagtggatgttaaataaatattgactgatattctttgttcaataatacttctgtccataggaactcaacaaatcttaactctttggtaaaactccttaagacattgaaaaacaagatatcatatgagtgccacggaagtatgaataatgtattaaggagagttggtatttagcttcttgccatttgatatgtaaaacagggctattataagtcttgagaacatgggctgcctctataatgaagagccaccaggaggcattggcaattaaggtaggctcttgcctgaagatgttgccatattttgtgatctcacactttgctttcagttcctggatggagtaaacagtgaatgagatgaatacattacagcagggaaaaagcatcctttgaaacatggagctgatggtgagtaggaagagtcaagtgagaggcatgcctgcctcaaacctaagaaatgtccacagggcacctttagcacaaaccacccagagtcctgtggacaccagccctggaaaggtagccgactgtaaggggctcctcctccacacagggaaatcacccttttctctgcacaaacagggaagccccagggtaaggctccagaggtcatgtgtggtttccatctgggccatctcatacagtcactttgcagttctgatagtcccaccatgtttttgttttggtagacaacatatttcttaagggtgggccctgctttcaatttcttttgaattccctaaaaactactctctagtcatctaggctaacaattgcagagaatgtggtgggattaggcaccagctatggttgcattttatgagatgtaaggtactttcaattctgaccattctatttctagattcccatgaaaaatcaaagagaccgtttcttctcctctagtggtgagcagccaccaatgacccttcttctctttgaacaaagtaatggtcattttcaagaagtcagaaaaataatctttagtttatgttctctgacagacttcgaggggagggatgacctggggcacagcatgggtgacacacccatggtgcatttgatccagagattacttgtattaaacattgactctttctagtgcttctccactgggatgttaattccctctctagttcaagctccttgcttgtccaggacacagtcaggcactcatcctcaggtggatctgtcgactctgctaatatagagagaaagttgagattgcactgcaggggcccaaagacctgggaattaaaattttaaaatgtgaaaggacttaagacttttatttgccatcaagctggatgcttctgggatttaaaagtggttgtaagagttaaagaaagaggaaagaaatgcaaaaagtggctcaacagtcaaagacaggttgattttggagaataaacctgagaggggcttctggtcactttggtcaggagcactctctcttacagactaagagtatttattggttttagggtgagagcttatcacaagcttggaatgtttccgtgttggggagaactttatggtggggttggaatgtctctggctggaggggaggttatcttgggcctggcatgcctctggtcggggaggagtttatttcttatggttggaaagtttctggtcagagatgtcatttgtggtttatggtcctgctgaccttagccattaggctgatgccctttggatttaggcagtttttgatcaaggtgaactttaaaatggcggtgcttgtccaagatggcaatgctcctactctgtcagtggtcccttccccatccctcaccagataaacccctggggtattggccaggcaaccgggatgaagcatgagaatggcccccaaaccaggacccatgtgccactcccagcctcagggctggcttctcccagcctctctcacacccagcagctgggacttgctgcccacaccacctgcgttatttggatttctttaaataaaaattttaaatagccatatgtcaaatgcctttccttgaatggtatctaatgtagtgtcatctatatatgtgctacccagattcatcaacttgtcagttacttatgccttgatgcctctcactttaaaaatgcctctcattttaaaaagaaataaaatcataaaagtactcctttaatccatcctttttcctccctccccagaattaaccactcttcctgagtcagtgggcattattcccatgatacccataaacaatacatggtattattttgttgttttttaaaataatcagaaatggtatcctagtatgcagccttttcaacttatatcttatttttaacttttgaaatgtatttgcattaataaaaatatatttgcttcattcattttaacatgtgtataatattccacaggattcaatccccaattgataggcaactaggtataatgtttccagtttctttctatcagaacaatacggacttcttcaatttactggctgttgtcaaaatgcttgccaaagagggtgtgtcaattacctttttgccagattggcataagagtttctatttctccacaacttgtcgacatttggtaatcagtgcaatctgatgttaagtaaagtgatattttaacattggtttatttgtaattccttgactttttgtgaggttgagcttctttccatatccttattgactacctagcttttcttttcagtggcaatcctatttgtatatttaaaaaatcatgttatttgtctttttctcactggtttgaaggagttctttacctatcctttatagcaatcctttgtcagttacatgggtttcaaatatcttttcctagttcatgactagacttttttttttactcctctatcatgtcttgatgaatagatatccttaattgtaattgagtcagatttatcaactgcaccttcatgatttgtgctattttagagcatcctttaaaaaatctatttaaaaaattctttaaaacaaggttacaggaaacaaagttaatatacaaaaatcaatggtgttcatatattagcaacaggcaattgaaaatcaaatgatcttccttgaataaagacagttttccttcttcctttctgatctttatgccttttattccttgctttataccattgctagaagcaccattacaatgttaaataaaagtgatgagagtgggaattcttgctttggcctagattttaggaggagaatattcaatatttcaccagttagtataatgttgtattttttgtagatttcctttattagcttaagaatgatctctttattccgagttttctgggaatttttatcatgtatcagtgttaattttgttaaacgctttttacacattcattgaaatgattacatgttttaaaatttttttctgttaaactgcattgattatttgatgttaaactctaccttgtttttcttagaaaaaaaaatctacatcttgacatattgtttttatatcttgctgggttgaatttgctaatatttttataagtatttttcaatctgtgttgatgttgctctttcattattcataatatatttgtcaagttttcatattaggcttatgatggcctcataaagtgagtcggaaaatatgcccagctcatctttttcctaggtttgtatggattaaaggtcttcatttgtgtttggtagaatgcaacagtgaaaccactcaagcctgcgattttctttgtaggaaggtttttgatagcaacttcaaaatttttaatagacataagactatttaggtttcctattttttgtctgtgtccattttggtaaattgtgttttacagggaatttgttcatttcatatttaagttaccaaatttgttggtattaagttactctaaatattatctagttatccttttaatgtctgtaccatgatagtaatagcctatctttcattcctgatgttggtagcttgtgttttctttattttttctcctgaccagtctcgttagaggtttatcttttaaaaagaaatatcttctcaaagattcagcattcttaattttttctctggcttttttttttttcttttttttgaaagagtttcactgtcacccaggctggagtgcagtggcataatctcggctcactgcagtctccgcctcccaggttcaagagattctcgtgcctcagcctcttgactagctgggattgtaggtgtgcatcccaatgtccagctaatttttttgtatttttagtagagacagggtttcgttttgttggccaggctggtctcgaactcctggcctcaagtgatcctcccacctcagcctcccaaagttctgggattatagtcatgagccaccatgtctggccacttttttttttttttttttctgatttcacgctgtcagactttatgatattgtcccacaggtagttggggctttgttcatttcttcaaccttttttttctttctattcttcaaactggataatttaaagtgtgctatcttttacgttaattgactttcctctgtcatcttcactttactctaagacttcaatacgttttactttcatgtacatatttactattctttcatttacttatttatttagtttatattcactgtagatttattattcacacatatacttctcagttctttttgtttttttcttgagacagagtcttgctctgttgcccaggctggagtgcagtggtgtgatcttggcttactgcaacctccatctcctgggttcaagtgattctcctgcctgagccttccaagtagctcagactacaggtgtgcaccactacacccagctaattttttgttttttgtattttttagtagagacggggttttgccatgttggccaggctggtcttgaaatcctgacctcccgtaatccacccgcctcagcctcccaaagtgctgggattacaggcatgagccaccacacctgactcccctcagttctatactttctacttggttatttttacacagtttttaaattttctttttctgggattttctatttttacatacattataagcaatatttctttatttcctcaagcatacttatactaattgttttaaaatctttatctggtcattgcaatgtctgggtcatctcaggttgatggctttttttctcttcagaacgcatgagacattcctgttggttgtgtgtttagtaatttccgattgtggccaggacattgtgttgctacgttgtggggaatgcagattctgttctattcctctgaagatagttgtgtttgcctgtttatttattttgtatgtttgttttgacaggcaatcatctccattggattcaaacgtcaaactctgcttcttgggtgtcattcaaacttcagtttcttcatctttagccagagtctgtcctgtatgtggatggtccatgggtcagagagagacttgggaagggttttcacacagaatttggagcttctcctctctagctctctcctttctgggattcctctttcgctttcctgcagctgggtttgcccttttctcagtacagtgattctccagcctgaaggaccacaggtttccactggtgttttagccgcaactatacaacacccactgtgacctaccctcaggcaaaatcccatacagaaataaattcgcagcattccctctccttcttccagggtcagctcccctccaggatctcagacagctgtgcttggtttgtttttctcactttccagtgccatcaggccattgctttgtgctttttccagagttttcattgttatatcaagaagggcagggtctagtatgagctggttgactatctctacttttagtgacttaaagttttacttttcactttgggcctgtaattcactttgaacactgtgggacttggacagagggaggaacaggcactcccccagttttgggcacggagacacagacaagcaatcccaacacaaatgtggcatattgtcatgctctgacatacatggtcatgcacagacggggaaggtacatggatgcatgtgtgtgcatctggccctgcaatgggtcaggaagctgaggagccacacagcataaacgggacggaccgcagtactaagtgtcctggctcaggggcactgagcacccaggcagagctcgtccagctccccaggaagccagccagggcagagaggaaaacttgttaatgggttgttaaattgtggttctaaatttacctttttcaatgtagataattaaaaatagcttagcgtcattaggtggggatctgaatttgtctttttaaaatacagataactgattgtcatggtaccatttattcaattgtcctgtttccccattgatatcaaatatattatccacattttcttatgtgtatggatctatttctgacctttctgttctgctccagttgtctgattttatccccgcacccgtacttccctgctttaaacacagtagttttgtaatcagtcttaatgtctgataggatagatatcttctgattcttcttttcctcttcctgggaaccgttctttaaacttttactaggtatttttggtgctttatcttttcatttaaatcctgaagtcagtttgtgacatttaattacaatcttcctttgagactttgatagaaaataagttgaatatatagtttattttgagaaaattaccacctttagaatccatggtcttctcatccttgaataggcacgtctctgcttcctcaattcttctttcaggcccttcggtaaagtccataatttgtctgcacatctagtcttcccttatactccaaagtctctcatgggaaggagctacacattttttgcctttgttctctctcaccaaagtctgtcacagttatctgcccagtaggagccctcaagaaacacatttagacctctgtctttgggttttatatctaaatacagaatccaattgtcagaggcatatgaaccagagcaactccatcttaaataggagctgggtaaatgaggctgaaacctacagagctgcattcccagacggttaagacattctaagtcacaggatgagataggcggtcagcacaaaatacaggtcataaagaccttgctgataaaacaggttgcagtgaaggagccggccaaaacccactgaaaccaaaatggccacgagagtgacctgtggtcgtcctcatttttacactcccacccgcgccatgacagtttacaaatgccatggcaacgtcagaaagttaccttagatgatctaaaaaggggaggcatgaataatccaccccttgtttgccatatcgtcaagaataaccataaaaatgggcaaccagcagccctcagggctgctctgtctatggagtagccgttcttttattcctttactttcttaataaacttgctttctctttgcactgtgaactcgccctgaattctttcttgcccaagatccaagaaccctctcttggggtttggatcaggacgcctttcccgtaacacaatgaataaatatagttggaactcttggtgttgtgggtgttggagaggagatttagctgagacatcaagaaacagtagatgtcatatttcaaagtgagacaatagaccatgaaacatcaaaaacaatttggctgagaattgttagatgattcttcagtattttgcctctactgatgctacaaaaggtttaagggaagggaattttgtagaaaatgctaagtgtgagaatttttaaggagttgctgatatgctgtgagtctctctcactgtcatcttgccacagggggtaagggtggggtgtgcctgtctctagtctcaggtcttaggaatgaggtcttagtgggtccaccaagagagcgtggtgcatgtcctccatggttggaggctacaggacaccggtttctgactcttggggactctaatatctagtgaggaacaggacgaaccgttaggatctgcctgcatcccagagtgtgttggggtgaaggaggcacaaatgtgtccggtgaaccacaggtaagccatggagctcaagagaactgtgtccgtcatcctagactttgtacaagagagacacttgaggtgggagcagacatcatctcagagaaaccaaagacaacaccatgttcccggggatgggaggagaaattgatgagctagtggaaagtgcatccccagtgtccaaggatctgcagatgaggaacccctgaagaccccccggaagcagcacatgagataaggcgtttgtttcaagcacctgatgggcccagagaatgtggagccaacctgggaaacatcagtccagtataggaagagcttccgttccccattcccagttccccttactcccctctaccctgcccttgccccaacaactgttcctacccctggagcagcaggccaggagagggagagggttcaatttattaattatggcaaattgcaaacatatattaaagtagagataatagtatgatgaacccccatcaatgagtttcagcaagtatcaacttatggccaatcttgttttatctatacttactacctctaattatccttcctgaattattttgaagacaattccacagattatacataatatttcagtctataccttgaagagatactgatacatgtaaacgtttacatccatatgtgtgtcatatacgtagagctacacactcaaagatccaccccatgctaaaaatgtccactaattcctttatggcatcaaatgaaaacatctaattttaagtcaagttcagaattttgattgtcatatgggactggacatgtcaactcctaaatggcaactatgcctaaatggcaactatgttttgtgactttagaaaccataggattaactgacttttctttccaaaagagaaggaaccaatccccacagaatgggagacaaagacaaagacacctagtgctgtggttggccccgtgagtgctgtgtggctccttagctccccgacccattgcagggccagatgcacacacatgtatccatgtaccttccccatctgtgcacgaccacatatgtcagggcatgatgctatgccacacgtgtgttgggatcacctgactgtgtctccatttccaaagttggggggggtgcctgttcctccctctgtcctagttccacagtgttcaagtctctggaaatgactgcagcccagtggggggcttgtggaatgtcctcttggcagggggtcctggtcccagtttgccaggcacactccctggccacaactcttgtcctggcatcattattcacagcacctccactcacctgtctgaaaagtgtcctggctttgacagcctctcacagggctgcctctctgtcccgctgtgccctgggcatgagctgccgcgtgccctgccctccatcgggcagagcccagcccaagccccaccagaacgcgagagtcccggagccctcaccagccagtgttgtcttagcctcccctgagacaaggaaatgggaatgaaagagtccactggggataattctggtgacaggggagtttgggaagggatcaaatacatgtctggggattgatgatagccagggactcatggagaccagcaatcggatgggtgccgggaaggacaaaggccgaggcctggcgatgtgtggggtcaaaggcatccaggcggccgagtggacccgtggtcctggctagggggcactgagcacccgggaagagctcatccagggccccagggagccaggccagggcaggaagggagaggtcaccatgagacaagccactgggatcgttcaatgtgtccttcccttccctcttccctcacaccagaaagcacaggctgaaaagaccctgctgccaggcgccccttgtgtgtgagggtcctgggccatcataaccagcaccgcaagctgggtggtttaaacaacagatgtttattcttgtttattctctctcagctctggaggtcagaagtccaaggtcaaggtgtcacagggcctcctctctctgagggctccagggaagtgtcctgcctgcctcttccggctcctgggggtgctgaagtccccggcctccttggcttgcaggcatatcactcggtctctgccccagttgccatcgccatgtggcctccctgccccgtctgtgctcacatctgcacccctgtgtgtgtctcagtgtttcttctcttcttataatgacactagtcatattggatttagggcccaccctactccatctagaccaggccagatggcgagcggatccatctagaccgagggtgtccagtcttctggcttccctgggtcacaccagaagaagaagaattgtcttgggccacacgtgaaatacactaacactaaagatagttgatgagccaaaaaaaaaaatcacaaaaaaaatctcataacattttaagaaagtttacggatttgtgtagggccgtcttcaaagccatcctgggttgcatgtggcagacagacctcacattgaacaagcttgatctagaccttatcttagtttaattacaaccgcaaaaactttatttccaaataaggttacattccgaggtttcaggagggacgtgaattttggggaggacacccttcaactcaatgtacttgggaatcacttggtgataaaggcttgactcacaggtatgagccaagtccgaaggccgagagtggctgcggcttcccagtctggtggtgggaggacctggctccccatggggtcccctgtgctgtctggggctgttgaacttggctgcctgcaccaatgcattcagggactgtctctgagaactgcatgccatcagcccaggtctggtacaagaggggctcccagctgtcggcccaggactggctcagtgcaggactgcagactggagtgcatcacacggaaggtgaggtgacacggtgcctccggtgcctgggtgagggccttgcaccctcctctcaggctctgcttcctggtagagcaggtctggctgctggggaagggcccatctgggcccagcaggtggggctgcgggtgaggtgctcctgtccaccgcggtcagctgcattatttctggccgtcagtccatgcctttctgggaacctttcctgtcccttgcacgtggggctgatgcaacggtcccaaacccacagacgctctgggtttagagggctctgtggctgcttctcaagacgagtggctgaaacagcaccaagtgctccttgagctgcacaagggaaccctggagcccatgcccccttccgagcccactgggctgctctgcgttctgaccttcctgttttacacgtggtggtggcatttgctctgctcctggtccccacccccatttgtcctcagtggactatgtgtcaagacagaagcatccttgaatgggtcactgcgtttgcctccccaaagcacctacattcaggtcgtgatgactcaggaagggtcttcgagcctctctcagggaggcaggaggaagttctgtgcagagtgaggggcggcacccatggcagctgcagaccgagagacagctgggcagcagggtgctcctgggaggtgtgcggccctgggccacccacgggtgctgattagcacaacttcctacttccttcctccctcggactgtctgctgcttgagtaatcgagtgacaataccagaaaactgagcggtgatgcagaccctataacctgcatgtgccacatcaactctgagttttctgtggggcagtgagttagtgcaaagtaggcagtgttatggccttacctgcccctctgcactttgggaggctgaggcaggcaaatcacttgaggttaggagtttgagaccagcctggccaacatggtgaaacctcagctctactaaaaatacaaaaattagccgggcatggtggcgtgcacctgtaatcctagcactttgggaggccaagagagatgggttgcctgaagtcaggagttcgagaccagcttggccaacatggtgaaaccctgtctctactaaaaatacaaaaattagccaagtgtggtggcatgcacctgtaatcccagctactcgggaggctgagggaggaggatcgtttaagcctgggaggtgtaggctgtagtgagctgaggttgaaccactgtactccagcctgggtgatgggagagaaaccctgtctcaaaataaaataaaataaaataaaataacttaacataacataaaataaaataagataagataaaataaaatgaaatgtgcccctctgaccttcacccctcccatctggtgaacttgtactcatccctcaagacctagtcagatttcaccccactctgccagctctaatcatactgcaccacaattcatgcttgaaggcttgttcctcctcaccagcctgtgagctctgagggcacgggctctgcctgatgttctggggctcccacatctgcaggccgagtgcctgacctgggacccatgctcagcttgtgcttgttatatgcacgtgacaatgaccacgcatccgggaggtgaaaggttgcagccccggcatgggggagcagactgtcttcttcttggatccatccaggagcccctgcacaaggcccagggtgggagggatttgcagggctcctgggacggcccacaccgccacaccgcacacagctgacgaggctgctgcagggatgcgggatgcggctcccaaggaggaaagggagaggctcctttagagccagtcctgctcacccccaggtcttgggttgcccaggggagccacctgtctgggttgggcccgatgcccactaccgcacggcctacagctctgacaacagctctgctttttctctggaactggaactcccccaggggaatagggtggctggggaaggctgtgggaatgcaggctctggaaggcaggttgggctctcccatgccatcctctgttcctgtacagagcccagggctcctggggagggggctcctagaacagagagaggggacacacacgggcctccccattgacctctccagaggtgcagcccaaatcccccttctctgagaagcctgtgcgtctccacctgacaggacccagctctggcccccttgccacagcctttgctcctaccagagccgggaccaggaatcctctcctctgccatcatggttgatccagcacacccggcaggtggtcagtgtgtgtcccaggcacctggctgggctgtgcagcaccacttcatgctgtcctgtggggtgagcaccctgtgacatgtagggaaactgaggtacagatgggacgtgacttgcccaaggtcaggcagcacagaacctagtcttggcttcaccatcttaactctgacatgatcccgtctccctttgcggggggactcttcaaggacaagaatgtgtcacctttgttattccttccccagccctaaaccctgggtgtaggcagtaggagctcagtcaacattcactagttaaacggaagcaaaccccagcagggttctcggtgctggccgcagagaagaatcacaggcgacagaaccacctgtcagggcggggcccaggcattgatattctccccactccaggcaattttgagtgcagcaggtggagaccacagcacctgcagaagctccttgcgggggtccttccccagcaggtcatgagggccggaggggcagcagtctgttcctggggtgtttgcaccctcctggaactcagccctgcaccacgacctggcctggcctctgggtactaggagcagtgggaaggcagggagatctcaccagatcccccagggagatctcaccagatcccccagggatttcccctacaatgacctttttaataacatgaaaatcctgctgtccattgatgaacctgggtccgctgtctcccagaaaaagtgagtgccccgaaaacaaggcaggcaacgctctttccttcttcctccttcgctggcctcagcgggagtggcacatcagaggccaggggccctcaaatccatccacaaagggcgtgctgagcgcaagggcggggcctgggagtcacagggcaggacacatcctggtgctcagcacgtacgccatcgagctcccatgggtcactcggggaagggcagtttgtggatgcacccttggaggctcaaggccgccctgcacacaccaccggggaccccagctgcaggctaaatccaagcagccaggcgctcccatttctcggggtgataaaccaagtccacccttcagacagaggctcctggaagggccagtgggggtcatcaaaatgcctccctggaaaagaaacacggagaacacaaaatctaggggcccgttttcctggaatgagattagtctcttgcccactaccagccagtccactgcaggaggttggggggttgggggatgctgcggatgccgagggcggaggcttagggtcctgggagtgggttaaataccagctataccagggacactggagtaacctctgataggcaccggaaatgttgagtcttagtttcttcctctggaaaatggatagaatcatcgctgtctcatctgatatgttgttataaaacaattcctgagatgtagtctttagtttttaaaagagcacgctgggcaaaggtggagagtcagttcctgtttgtgttaaaaatgtggccgagtgcagtggctcatgcctgtaatcctgacactttgggaggccaaggaaggcagatcacttgagtccaggagtctgagaccagcctggccaacatggcgacacctggtctctaaaaaaatacaaaatattagctggacacatgcctgtggcccagctacttaggaggctgaggtgggaggatcacttgagccccgcgagggcgggggtctcagtgagttgagattgtgccactgcactccagcctgggtaacagagcaagaccctgtctccaaaaaaaaaaaacaaaaaaaaaacaaaaaaaaaacaaaacaaacaaacaaacaaaaacaaaccaaaaaaacgtgcttagatccagagagaaaaattctgaaaggatacctaaaaaagtgttcacaatagatcaatagatgcctctggataggaaaggctcttttgtattatttgattttaaaaatcaattatgtgtaccatgtttttactaacatattttcaatcaattcatttcatccacttattaaaatgtagttactaatttttaggggagaaagcaaaaaggaaagacaaggaatctctgtgtttcaggagttgtgagagagccgcagggtcctgactcactcagagctgcctgtctccgaggccgatctgggatgaagcagcctggggctctcttgtcatgggaccaggggtgttctgagggcttctggctgggaggctgagatggaacggacaccacaccctggtcctgccaccccacatggctcctgcacactacaccaggccaggctaggagggcaattgacacacatccgctccccagtagaggacccggaaccagaactggaatccgcccttaccgcttgctgccaaaacagtgggggctgaactgacctctcccctttgggagagaaaaactgtctgggagcttgacaaaggcatgcaggagagaacaggagcagccacagccaggagggagagccttccccaagcaaacaatccagagcagctgtgcaaacaacggtgcataaatgaggcctcctggaccatgaagcgagtcctgagctgcgtcccggagcccacggtggtcatggctgccagagcgctctgcatgctggggctggtcctggccttgctgtcctccagctctgctgaggagtacgtgggcctgtgtgagtactgccctgactgccccggtggcagggtgggcgtgaagggaagggatccaggataaggggggattctgcattcatttaataatggccacctgtcacatatacactttttcctgcgctagccctttgaagtgggtctttattgtccccatttcacagacaaggaaaccgaggctcagagaaagttaacaacttatccaaggcagccctgcccagtctgtgttgaaatcagggtttgagcctgagcccatcccctatgaccccatagccatctttgctggagatttctaaattacaatataggtctttatgcattgttccacatttacaaagaaaaaggaaagatgcaggagaaaaaccctgacttcagaacactgtcaataccggcaggcacaaggttcatttagccattgcatagcaaccctgccatggggtgtggctgctccattaacccaagtttgaaggaatgagggcatggcttttatctgggtgtcttctgagcagggtcaaaggcagtggttcccgaacttgcagcccattagaatcacctggagagctttaaaaatcctaatgcttggggcacaccagttacatcagggcatctccaggcaagatccaggcctcagctgttttgttttgagatagccttgctttgtcactcactgctggagtgcagtggcacaatctcagctcactgcaacctccgcctcctgggttcaagcaattcttgtgcctcggcttcaagtagctgggattacaggcatgcaccaccatgcccagctaattttttggatttttagtagagatggagtttcgctatgttggccaagctggtctcaaactcctggcctcaagtgatcctcctgccttggcctcccaaagtgctggaattacaggtgtaagccaccatgcccagccaacgtcagtcatttttaaagctctgcagctgattccagtgtgagcgaagtttggatgccaggaggataagcaattacggactgggagcaagagaagggaatgtaagacactgcacgtgattgccattttcctaaggaaatactcagttcgttaatgaaacgcagtgaacttctgctgcacatacagacatagaggcttgcctgaaacatgaaaatattggggactgaaggatgtcccgggagggtgggacatgctcaacaattcaggaaggggagatgcagaaaaaagtgaaaagcaggcagcatgcgttgcaatgatctctatggcgtgtgcctctcctgtcacggttttcatttaaaacaaaggggcaaggttttgttggtcaaacaatgaagggtaactttgtttctgggttcaagggaccccagattccccaggggttcctgccagctggaaggtacccaggtccgtatgtgacttcccgagaaggtgataagagcgtgccaaggagaaagacacttaggcaaatggccagagtccccgagctgagcatttaacagactgcctctctttaaatattcacagggaaagtgcatcttcctaagggcgagggtttcagcagtggttgaactcggcggggtggggcggagcgggaggatgcaaacttgcaaagtgaagcaaacacactcaccgcagcccagcaagggctctggcagctgacagggctttgtctgggacagctgcaaaccagtgtgccgtgccagccaaggacagggtggactgcggctacccccatgtcacccccaaggagtgcaacaaccggggctgctgctttgactccaggatccctggagtgccttggtgtttcaagcccctgcaggaagcaggtaaggccccagtggcatcgtggtctgggcccagccccataaggcagggggtctcagggcctccctgtcctttctgggctggagatggaggcacaaggaccccaggaagccacacacacacacctgttccaaggcctcagagcagaggcttcacacttagggcagccatggccaggggctgtcctcttctgtcccctttatgtaaaacataaaagcaattgtttcaaaaaggtgttcaaaatgatggcatcgcatagagggaactgatttagtaactattcttgagagaagtggaaacgcataggtgtggaaagccgggccgacttttgggctgtttttgcaaatcggccccccagagtcttgtcatttgtggcatcccctacacagacggcaggcggtcccagccctagacgtcaggcctcggtgccacaccccacctcccccactctgccccccacaagggtcatctcctctccctctctctgccgtggtggagggcaggtgcagggcaaccaccctgggggttccctccccaggggcggagagcctgcgtgctgtgcgggtaacagatggccctgcacacgggtttgccaccctggctccaccaggcttagctgccccacatcgtgggtggggcgattggctataagccatctgccatgtccaagtgccagctcagcccccacgaaggccgcacctgcgtgaggtaccttcctggaaccagcatccagaggggcctctcttgccctttgtcctagggtgaaatgcgggaggctgagtcctgctggccccggctccctgatcaatgatgggcccctgcccagggcctcccttcaccctccccagcaagtccagggtaggggtgggggtgggggtccagagaaggccaggagagagaggggtctggctactgtccactgccggtcctgttccttcagctccactggaactacactctcctctgagtgccagccatggccctgccaaggcccatctcgcttgttatctgcctgatccctgggtcccactatcttgcttagcaacccgaggtgggaatcttggctattcccccatgtggtggggactcaacactccccggtgactctggggaggaggcagcactaggtgctggccttggagcctgccctgaccttgggaagctgggcagcgtgggtggagagagactgctcacacaagcctttgctctgtttgcagaatgcaccttctgaggcacctccagctgcccccggccgggggatgcgaggctcggagcacccttgcccggctgtgattgctgccaggcactgttcatctcagcttttctgtccctttgctcccggcaagcgcttctgctgaaagttcatatctggagcctgatgtcttaacgaataaaggtcccatgctccacccgaggacagttcttcgtgcctgagactttctgaggttgtgctttatttctgctgcgtcgtgggagagggcgggagggtgtcaggggagagtctgcccaggcctcaagggcaggaaaagactccctaaggagctgcagtgcatgcaaggatattttgaatccagactggcacccacgtcacaggaaagcctaggaacactgtaagtgccgcttcctcgggaaagcagaaaaaatacatttcaggtagaagttttcaaaaatcacaagtctttcttggtgaagacagcaagccaataaaactgtcttccaaagtggtcctttatttcacaaccactctcgctactgttcaatacttgtactattcctgggttttgtttctttgtacagtaaacattatgaacaaacaggcacttttttgtatttgtttgctaattaagtttaaacatctgtgacacattgggtggccttcttttctctttttttaaaaaaatggatgcagctataggaaatgaatgagctggtggcagtggggattccatctcacgtcctcatgaagccttatccacttctggacctgagtgtggttctctccccatcgcactgtcttgggacacggcagctctccgctcccaccaagacggttttagatgtacgaaggccagtgagcgctgcctggctgggcctcctgtgagcgctgcctgcctgggcctcctgtgagcgctgcctgcttgggcctcctgtgagcgctgcctgcctgggcctcctgtgctgctcccactgccggggctctcttagggccggatccacaattccactgcagtgcggtcacagcggtggggttcttgctctgagctatctgttcccttttgaaaagagacaactgctcctttaaaatagcagcttttgtttttgagcttgcactcggggcctggtccctagagctcataacatccctagaagggaggtagtattgcccttgtcttacagatatggaaagagactttcttgaagtagcttgtccaaaagcccctactgagaggggacactgtcaggatgtcctggtctctaaatctcaagccctgggtgtcccatccaatgccccgaagcatcagctgccagccctgggagggaaacttccagggctatcccgggcctcagagcacacgccaagtgtggcctccctgctctggagctctgctactgagagctgctctggccgggacatcctccgaggcggggctctgcatccctctccctcacagaccatgcccagcctttgagggctggagggatggaaaggttggccccaggccctggcctcagcctcaggccaccctgccaccagctggatgaccagctccgttttcctcctaccccacctggtgccctgtaccccgggacagggctctgctgcctccttgcctcattcatgggcaccgcccacctacatttccaaagaatttcttgacttgccccaccccgccgttcctggcattgccttctgcagtcactgcagacacctcctgcactgtggtccccccggcccagacttcccactgtgccctgagagggagggctcccccaga

SEQ ID NO: 58 - DNA, 25 bp, artificial sequence
  TFF1 forward primer
taaggttacggtggttatttcgtga

SEQ ID NO: 59 - DNA, 31 bp, artificial sequence
  TFF1 reverse primer
accttaatccaaatcctactcatatctaaaa

SEQ ID NO: 60 - DNA, 37 bp, artificial sequence
  TFF1 probe oligo (6FAM--BHQ-1 format)
ccctcccgccaaaataaatactatactcactacaaaa

SEQ ID NO: 61 - DNA, 490 bp, Homo sapiens
  misc_feature (256)..(333): amplicon location
gttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggcccctcctggctggcgagcgggcgccacatctggcccgcacatctgcgctgccggcccggcgcggggtccggagagggcgcggcgcggagcgcagccaggggtccgggaaggcgccgtccgtgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctc

SEQ ID NO: 62 - DNA, 18 bp, artificial sequence
  TGFBR2 forward primer
gcgcggagcgtagttagg

SEQ ID NO: 63 - DNA, 20 bp, artificial sequence
  TGFBR2 reverse primer
caaaccccgctactcgtcat

SEQ ID NO: 64 - DNA, 21 bp, artificial sequence
  TGFBR2 probe oligo (6FAM--TAMRA format)
cacgaacgacgccttcccgaa

SEQ ID NO: 65 - DNA, 1344 bp, Homo sapiens
  misc_feature (399)..(399): n is a, c, g, or t
  misc_feature (401)..(401): n is a, c, g, or t
  misc_feature (656)..(656): n is a, c, g, or t
  misc_feature (1051)..(1143): amplicon location
tctgtcgacttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctcgaaacagcagatggcttccatatccagagagcaagaaccagagagagagagaaagagagagagtttgggtctttctcctctntncctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggngggccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagacggcgcagagcgggcagcaggcaggcggcgggcgctcagacggcttctcctcctcctcttgctcctccagctcctgctccttcgccgggaggccgcccgccgagtcctggccagcgccgaggcagcctgcctgcgccccatcccgtcccgccgggcactcggagggcagcgcgccggaggccaaggttgccccgcacggcccggcgggcgagcgagctcgggctgcagcagccccgccggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcggtaagcgctcctggtgccccgcccgagccccacgctgcag

SEQ ID NO: 66 - DNA, 21 bp, artificial sequence
  TIMP3 forward primer
gcgtcggaggttaaggttgtt

SEQ ID NO: 67 - DNA, 22 bp, artificial sequence
  TIMP3 reverse primer
ctctccaaaattaccgtacgcg

SEQ ID NO: 68 - DNA, 19 bp, artificial sequence
  TIMP3 probe oligo (6FAM--TAMRA format)
aactcgctcgcccgccgaa

SEQ ID NO: 69 - DNA, 4825 bp, Homo sapiens
cgggccctgcgggcgcggggctgaaggcggaaccacgacgggcagagagcacggagccgggaagcccctgggcgcccgtcggagggctatggagcagcggccgcggggctgcgcggcggtggcggcggtgagttgagacgcaggaggctaggggcagctttgagccctgtcccaagagcctcggtgaaggaaggggccccgggcgcgtctccactccaagcctcactgggggctgggttggccgccctttccgatctcgttaaaggctcctccagggcgtagcccttccactgagaggaaacccctcccaggagggtctgggggccccaggcagagcattatcagtgtccctcccccaacagaaagcatgggtgggggtgggggcgctgctggattcctgctctggtggaggggaaacttgtgaggggctggtaagcgccccctccgaagcctggtgtgtgcgcggggggaaggaagttagtttcctctccacccatgggcaccccttctgcccggggcctgggaagtgggctgctctgtgggcaaatgctggggcctctgaaatggaggagacgcagcagggagaggccccacgtgggcagctgcgctgagagtcagcagcacctgtcccccaggcgctcctcctggtgctgctgggggcccgggcccagggcggcactcgtagccccaggtgtgactgtgccggtgacttccacaagaagattggtctgttttgttgcagaggctgcccagcgggtaagtggccacaggggtgggagaggcatggggcaggcagggctggagaggtggcgggcaggcccgggaggtaagaggaggctggcaggggaggtaggggtaggctgacagagaagtagggagctggagagaaagagggagggagggcagggtgggaagcaggtcgggggttgctgggcagcccctctgcctgcctgacccctgcctggttccacagggcactacctgaaggccccttgcacggagccctgcggcaactccacctgccttgtgtgtccccaagacaccttcttggcctgggagaaccaccataattctgaatgtgcccgctgccaggcctgtgatgagcagggtgaggggcttctcagtgcttggcagggagttcctaaggacaggcctttctgaaggaagtggctggctcgggcccaaacttggggtgtgagggtcctgcacccacccttgccagaaccctccaccctgatcctccttcagggtgcccttgccccttctctcttcctggtgaccttcccatctctccatgtgccttggcctctggtcggccttaatctctgagcttctctcttttttagggtagccctgtacctgtctgtctttcgcctatttctgtctccattatcttgggataatgcctctgcctctccatgggagcctttggccctgactaactctccactccccatctccctgcacccccaccagcctcccaggtggcgctggagaactgttcagcagtggccgacacccgctgtggctgtaagccaggctggtttgtggagtgccaggtcagccaatgtgtcagcagttcacccttctactgccaaccatgcctagactgcggggccctgcaccgccacacacggctactctgtgagtacccccacccagggctctctactcccagacccccttctccctgcctgacccactcctgtcccatggtgacgcatgcctctcctggattgcaggttcccgcagagatactgactgtgggacctgcctgcctggcttctatgaacatggcgatggctgcgtgtcctgccccacgtaattcctagctgtcgtgggatggagggaagggcggctgggagcagagcaggggcctggggtggggcaggtgctgctggttcaggaataggaagaggggatagggaggagggagccttggccctgtgatgggtgggccccacttcaggcaaacttagatggcaaaagagcaatctggatccgccttagccagatacataagggtatttgccttcactttcagccagcattccccccagcgatcctagccagatattacagatgatttgtcacttacacagagagtcacattgatatagctttaaaacttgggctgaaggaggttgaggctgcagtgagctatgatcgtgccactgcacttcagcctgggcaacagagcgagacctattaaataaataaataaatattaaatctattaaatattaaatattaaatctattaaataaataaatacaaagggctgagagtcaggactgtgctgctagttctctaggggatcttgggcaagtgcagagaattcgcgtctctgatgtgtggtgtccctttctcaacatgggatgttagcagctaattcacaggcctttgatcagaggtaagggactttctgtagctattcaagtcttttttttttttttttttttttttttttgagatggagacttgctctgtcacccaggctggagtgcagtggcacgatcttggctcactacaacctctgctgcctgggttcaagtgattctcctgcctcagcctcccaagtagctgggactacaggagcccaccaccacccccggctaattttttgtatttttagtagagacggggtttcaccgtgttagccaagatggtcttgatcacctgacctcgtgatccacccgccttggcctcccaaagtgctgggattacaggcatgagccaccgcgcccggcctccattcaagtctttattgaatatctgctatgttctacacactgttctaggtgctggggatgcaacaggggacaaaataggcaaaatccctgtccttttggggttgacattctagtgactcttcatgtagtctagaagaagctcagtgaatagtgtctgtggttgttaccagggacacaatgacaggaacattcttgggtagagtgagaggcctggggagggaagggtctctaggatggagcagatgctgggcagtcttagggagcccctcctggcatgcaccccctcatccctcaggccacccccgtcccttgcaggagcaccctggggagctgtccagagcgctgtgccgctgtctgtggctggaggcagagtaggtggtgtgctgggaatgcgagtgggagaactgggatggaccgaggggaggcgggtgaggaggggggcaaccacccaacacccaccagctgctttcagtgttctgggtccaggtgctcctggctggccttgtggtccccctcctgcttggggccaccctgacctacacataccgccactgctggcctcacaagcccctggttactggtaagtacacacacccacacacgcacccagaagcctggggtcaggatgggtagcccagagtctactcaaccctgatacagaaggggaaactgaggcagggagtgtggggtgcagaggaaccctagaggagctgtaccagcacccaggtccaggaggcttgcctggtggctgaccgcaatctctctgtgtctgtcagcagatgaagctgggatggaggctctgaccccaccaccggtaagaacctcactgtgtgattctgggctgccttctggagctggaagatcaagccttactatgatccctggagcttggcacgcggccagcaccgggtagccctagtggacagaggtgttgggagcagagtcatcagtggatgagaccagcacagtgcctgccctcaaggggtgctcagtcagctggagttcagattcgtacacaggagctaacagttcaatggaaggagagccccatggtgctgggggacaagaggaaggaggcgggggcaggggactcaaggcagaagcaagagttctgctgggctacagtgagagcagggccaactgtgggaggtgtcattgcgggggtgtctgctgactgaaccagggactgtcccctcctggagaggcactgcgggtaaggggccttacttggcaagcagggctgacctggggcccctcttggcttccaggccacccatctgtcacccttggacagcgcccacacccttctagcacctcctgacagcagtgagaagatctgcaccgtccagttggtgggtaacagctggacccctggctaccccgagacccaggaggcgctctgcccgcaggtgacatggtcctgggaccagttgcccagcagagctcttggtaagggacatcagtggcctgaggccttgaccccattctcctgtctgcggtgggaagttgtggtttcacaacgtgttccctttctgccccctaactgacggagtccgccctatgccctgacccaccggatccagcgggcttcagccctggggtacccgcacgaacgcccctgactctgcctcccgaccgcggcccacgtaccccaattggctctctctggccctgccccaggccccgctgctgcgcccacactctcgccagagtccccagccggctcgccagccatgatgctgcagccgggcccgcagctctacgacgtgatggacgcggtcccagcgcggcgctggaaggagttcgtgcgcacgctggggctgcgcgaggcagagatcgaagccgtggaggtggagatcggccgcttccgagaccagcagtacgagatgctcaagcgctggcgccagcagcagcccgcgggcctcggagccgtttacgcggccctggagcgcatggggctggacggctgcgtggaagacttgcgcagccgcctgcagcgcggcccgtgacacggcgcccacttgccacctaggcgctctggtggcccttgcagaagccctaagtacggttac

SEQ ID NO: 70 - DNA, 20 bp, artificial sequence
  TNFRSF12 forward primer
gcggaattacgacgggtaga

SEQ ID NO: 71 - DNA, 20 bp, artificial sequence
  TNFRSF12 reverse primer
actccataaccctccgacga

SEQ ID NO: 72 - DNA, 25 bp, artificial sequence
  TNFRSF12 probe oligo (6FAM--BHQ-1 format)
cgcccaaaaacttcccgactccgta

SEQ ID NO: 73 - DNA, 188205 bp, Homo sapiens
  misc_feature (51360)..(51434): amplicon location
aagcttcagggggatgctaacatcaagaaagcagagagaaggctgattaactaggaatgggttaatgttttcatggttaatgtttagagggttttagtttagatggctaaaactaaggataccgaaagcaaatactgaatgctgaggaataagccagtgtccagagaaccaatagagaaaacaatcaggggtaggaagtattcctgggtaccttccagcaggaaggagcagctgcagcacagctcaaaggtaggcctgccaaagggacaaatgaacttggcaaaagcttttctatcttcttgggtggctgaagtgaaaggaacacaaagggtttgggagaggtgagaagctgtacaatcagaatgatataaagctcactattaagtttcacgaagtattcaaaatgatgataagtgcatgataataaatgataatgctagaaagctcactaataagtttataattattcaaaatattggtttcttctgagggctgtgagaacaaatcggttccatgtctcctcctcttctggcggtttcctgacaatttttggtgctcctcagcttaaagactcatctccctgatctcttcacctggcattatttctgtgtacccatctgtcaccatatttctttttaatcatcttagattaagtcatagatatattagattaaggcccacccttgatgacctccttttaacttgagtacaactttaaagactctatatccaaataaagtcacaaggacttccacatatgaatggagggggtcataattcaactcatagctctttactgtattcaacacaaggaaattgggaagtcatttcaagactgtatgcctagaaatccacacaacaccatacctactctcttacttacaacccttgctggacctgttgcttgttgcagggtttagtaatttcccagcttctctccataagtgacacactttccttctgctttcaaacccccaaatgctgtatgtcttgatcacaatcaatcagggggcatgactctactcagaaacatactactacctcaaatcattttgctttccatgtcaggactcttctcctcagagcaggaaaaacttactgtaagacatcaatgcccagcctttctagtctcctattcacagtgtaagctggaaacactgatgctttcagggctaagtgcttcatctgaaaagctttaacttctgaaattcaaaattatttgtcttgttttttgacattattatgtctctcctgtggcaatgaatggaggaaatggaggaaaggtcctggaacaaaaagaactaccaggaattaaacttgcaccagttcacatggtcatacctaacatgctgatattttttcctactagaaccgatattctccaaagtgggtttctcaaagagctgtctttcagtgtcaaaatcaggttatcagaaagtgcaaaaaaagaagaaaagttttatattaaaatatatttcagaaatgctgaactaaacaaatgaatttagataagaaagagaccttaggtttagtctaactttcttttttggcagttgaaatacctgatcacagaggggagaaataacttatccaagactgcagctactgatacaaattagaatgcagctactaatacaaagtagattatagctactaataaaaaactcagtatttgtactgaatactatattgcacacacagataaaatgtataatagaaaataataacataagtattatttaattcaaccaacatcattgacacctaaaatatactgtcaatagcctagacactaaagataatagtaaagaacaagacatgaatattgagtttcaggcattcatcaggtagatgtagtataaccctacaatttcactcggatgacatccataatcaccacacattaagaggacacaactatgctatagtatagaaagaattgcacaatatctattataatgacttgccactcaaacaacttagatatactttataatgtgaaaacaacgttagttactggaaatcataccaaattaacctgttaatatgcttataaaaattcttagaaaatatgccaacccaaagactattgataagaaacccctttgttgcatatatggaattgtttttagaagggtagataaaagtttagaataaataaaaatttacctccatgaaaacggagaaataataacttcagagaactgtcaattccaattttaagaaaaccacacacattcagaattagatgggatcttaggcattaactagtccatccaactctttcattgatgatataactgaggtgagaggaattaaggtacttatacatgtttataattatcttgaaatagtgtgagaatacatagcaaaaccttcaagttttgtaaataaaatgatatactaaaaaaaccaaataagagaaggggaaagaaatgtaagcaggattttttgatgctgcatgagtagagataatgacaaatatatgtcaatgtgaacaagtacattagtgtatttaagataagtaacacaaactactaccacaaagtatttgattaaaacattaattgtgatttgaaatgagatctagaagatattataatctcttccttatggaagttaacatactattacaacagaaaaagcctactaaaggccaatcaacaagatctgtgaaagacaaaccttgtaattctcatataatattttatcaacctaagggattgataccaaggggtatcttcacctatatcattttgtgtaatttaggtgaaatttgtgataactcgaagaaaattaaaattcaccccaggaatcatgatcaccatatgtagaaaaacagaagaagaatcatatttcttttttgtttgttttgtttgttgttgttgttgttgtttgtttgcttttttaaattattattatactttaagttctagggtacatgtgcacaacgtgcaggtttgttacatatgtatacatgtgccatgtttgtagggacatggatgaagctggaaaccatcattctcagcaaactatcgcaaggacaagaatcatatttctgagacaagaaaggaaaagacagagagaaaatatcatgtaagtgcatttttcacatatgtcatggattgtgtatgaagtggctttctgtgatggtgacatgatgaaagcagaaacgctctgtaacttgatcaatgtaataagatatataaaacaaggttatccattcagcaaatagtaatgtgtgaggtccattgttataaggtgtgacagtctgataatactcagacctcactcaacaggtagtttaggtaaaaagagttaaaatattatatttcatgacatagctgtttaaaaggtatatacctaattacttaccaccatatcatgtggtactactacgtagtacatagtgcttttaccacagagatgttgtctgtgaataagacatattaacaaaaatcccatgctcttttgtaagattccaaaaattctcacataagtaattcagaggcctagaatacatgaatctttgaaatgagaataaaagacaaaattttccaaacaccttggttttcaccgtttgtactaaatgaattggcaacagcctgtgattgtagaatgagtaagatcactacagtattagttgaagacagctgctaccgtaatgggaaaaggaagaataatgtatagcctgtggcctaatcttgtgggaacaaatctagattcagtaataacaaggcagtgttactaggagcaatcttctttaaaattacaccataggttctggtaaattcatggtaaatctatgtttgtgtatcctatttttttgtaattgattgcaaggacgcaagagattttgggtttaataagtatgtatcttcactcaaaatgaaataaaaattgcataggtgatacagaaaatttggccaaaacttagacatcatcattttttaaatgaataggagaaaatgaatatttgtaaaagatatactaccaccatttattctgccttcagctctaaagccaccagcctgaatcaaagaatttgagactttgtctctcagctcaaactatgtattttctatcttagtactcctacacatttaactttgttttactctcaatctcatgttattttagaaactactgaaattaatactagtagaaagctgatggaaactctctgtggataaaatacgtatttttattaagccactttactcctggcaactgctctcatggtgtcgtggtggtagcattcttaaaatgccaacattccactggtactgaacgctggcacttctcacaaataactgagaactcaagtctaacccatatgaatttcacacctcacgcctagaaaagtacatgatttcagggtggaggaataaaatgatagaacctcatgatgaatgtactgattaaaaggtaggttatcactctctgtctttactcacacctgataaaatttgaacagataaatttttaaaaacctattaatggaatcttagtccctcagcttcttcttgttggtaagttagctgttagttaaatcggtctctttcatgagagtgtcctggtctttcagatttctcttttctaatgcctttcttcataatgccacctgggtgtgttatacatttgactctctagcatcagcctctacagctcccccttctaccccacaagcacccagaaatgtgtggatcttttgcacgggataaacaggctgtggagaaccaggaggtagttttttttggttcatacatctagctgccctcttcctccaagagtggccaagtctcagcagaaagttatgtttctgctacagtctgaagcttctctgaatcatgtctaaatgagcatgtttcaaatgccaatacatattcttcagtatctccatacatatctacatgtttacacaaccccttcaaagtttaaccacaataatataagaacttttgcatctgacttcctctcccgactgcctatgtgttctgttctatgtatggtatttagcaacctagatatgttgatataagtttaaagtaaaaactctttaactcctttaatactattttctgacatggatttaaaaaaagaaacattcctttagtcaaggtgacatctacttttctcttgatgagaagaaaattgagaagagagtcaaaagaaagtaggatttcacagcacgaaaatgcatttgaaaatattttgtattgcatccccaacaaatagctatactataccatctactttctcaatattgataaatttcccaaactcaaggagaaaaaaggcctttgtgggtgattggtttcagaatgttacagcacatcttttaaagctgtttgaagggaaacactatacagttaatgatgaccaatagtgagtgatcacacagagcataaaagagagtgtacacactgtctgtggactccaatattttcaagactagggtatgtacacaccctagggcagtttttaagagtgtagtccaagatttgcttacgtcaatacgctaatgtgaggcagatttcatggccccagcttagatcaattgaatcagaatattttaggttgggagttggtattatccattttcaacaagtttcaaggatgactcctatgcacatttgtgactgagatactctaaaatttgatgtctcacaaagggctatcgacatttttttctcctttggaaaagttggtgaagcctaaacgtcaccagtctataatgatacaattaattaatactagcttgcttgtcagagattagaaagaaaggaatgtgtatattggattctaacaagtgatagaaaaaacacaaggcaaaatatactatttctaatattcctcgtttcattgctgcttgacatgtcgcaaatcttactaatccttcataaattatcacctatgaaatttacatttaattagtttatgaaaacttcacaaagttgttataatttcagactttataaacttaaaatttatcaaatacatatatggattgaatggcataaacaacagtattttcttccatgtatgcagaccacaaagggcttcagcaatattaccataatttttgacaaacccgtgcacgcacacaagcgcacacacacacacacacacctgtggtatacatttcttgtcctttttcttcatacttcctcaaacattatttctaatatcctatgctctagtttagttatttattttactcataaaaagacatacagtcactaagtttccccagcaatgagttttaagttatgcactgttagaaagaaatatttattccccacttttcaaatttccttgcagagggatttcccctgagcatttttgatctctctccatttcactgggagaagagaaagaggcagagaaatatatctgattgacaaaatgtggaacaaggaatggaatctgcatggctcatcccttacatgtttcccccttctgagaagttcactgccatgatggttaacattaagtgtcaacttgattggactgaaggatgcaaattattgtttctgtttgtatctgggtgtttctgggtgttgccagaacagattaacatttgagtcagtgcagctagaaataaagcaggcaaaagaaggtggaaatagctaacttgctgagtcttctggcctccatctttctcctgtgctggatgcttccggctctcaaacatcagactccaagttcttcagcttttatactcttagacttacaccagtggtttgctaggggttctccaccctttggccccctactgaaggctgcattgtctgtttccctactatgtccggaactggtgggttcttgatctcactgacttcaagaatgaagccgcagaccctcgcggtgagtgtcacagctcttaaggtggcgcgtctggagtctgtcccttctgatgttcagatgtgttcagagtttcttccttctggtgggttcgtggtctcgctggctcaggagtgaagctgcagaccttcgtggtgagtgttacagctcttaaggcagcgcgtctggagttgttcattcctcccggtgggctcgtggtctccctgggctcaggagtgaagctgcagatctttgcggtgagtgttacagctcataaaagcagcgaggacccaaagagtgagcagtagcaagatttattgcaaagagcgaaagaacaaagcttccacgttgtggaaggggacccgagcgggttgccaatgctggctcgggcagcctgcttttattcttttatctggccccacccacatcctgctgattggtagagcccagtggcctgttttgtcagggccagattggtgtctttacaatccctgagctagttacaaaggttctccacgtccccatcagattagttagatgcagagttttgacacactggttctccaaggccccaccagagcagctagatacagagtgtccattggtgcattcacaaaccttgagctaaacacagggtgctgattggtgtgtttacaaaccttgagctagatacagagtgccgattggtgtatttacaatccctgagctagacataaaggttctccacgtccccaccacagcagctagatacagagtgtcgattggtgcactcacaaatcttgagctaaacacagggtgctgattggtgtatttacaatccctgagctagacataaaggttctccaaggccccaccagagcagctagatagagtgtcgattggtgcactcacaaaccttgagctaaatacagggtgctgattgctgtgtttacaatccctgagctagacataaagactgtccacgtccccactagactcaggagcccagctggcttcacctagtggatcccgcacctgggctgcaggtggagctgcctgccagtcctgggccgtgcgctcgcattcctcagcccttcagtgatcgatgggactgggcgccatggagcagggggtggtgctcgctggggaggctcgggccgcacaggagcccatggagtgggtgggaggctcaggcatggcgggctgcaggtcccgagccctgccccgtgggaaggcagctaaggcccggcgagaaatcgagcgcagcgcaggtgggccggcactgctgggggacccagtacaccctccgcagccactggccccggtgctaagtccctcattgcccggggccagcagggctggctggctgctccgagtgcggggcccgccaagcccacgcccacccggaactccagctggccggcaagcgccgcacgcagccccggttcccgctcgtgcctctccctccacacctccctgcgagctgagagagtgggctccagccctggccagcccagaaaggggctcccacagtgcagtggggggctgaagggctcctcaaatgccgccaaagtgggagcgcaggcaggggaggtgccgagagcaagcgagggctctgaggactgccagcacgctgtcacctctcactactattgaggttttgggactcggacttgcccctcagcttgcagacggcctatcatgggacttcaccttgtgactgtgtgagttaattcttcctaattaactccccttcatatatacacgtatcctattagttctgtctctctagagaaccctgactaatacaccggcctgccgagagtatgcattctggtttactcctccaagccacaaattttacaaaacaagcactctcatctgaagaagtgctgtttaatgctgtctgtaacttgataggtaagcctaattccaatgttcagtattagaaatctcattgttgccatatcctgcaatacaccatttgtctgcagtaagctcatattttgatatccatctgcttgaaagttttttgtctatctctaaattggtttcaaactcagaaggaaaataagagtaatatttattgtacttctccaatccccaaaactattacataatttaagtaaatatatgtataatttgtaacatatggctactcttattgtatttcttcatattcctctttgtcaacctccaaagtaggccttgtatttgtatttaagaaaaaactatgtcatctacaaatagtgacaatattccagaatagaagccatataaccatataacagattgaagggttaaatgtggcagcatcatttcaacttttttttaaccttagtgtaaaataattgataacaataattggagaattttcattcctcagtccttctatttctctgtgagggaggtttcttcagactaaaatccaggcctctttcctggtccaatcattattccccctttttttctggaggatgaagttatgaagaacctaggaatgtgtgccccagcatttcagaatctaatctttggaacatgcctacctcacagagcatatgcaccagcagtttccgataagcagtattttgtgtggcctgtgcctttctggcatttcttgtgcccatgcagataattctgcttgtaagtaggtatagtattacgaagcttattatttccactaacctgagccatattctacaaacagttttgtcagccattagggatctgtttccatctacagttttctagtgcctatcagttgttttcaaatcaccttggagataagggagtgttatttattaggttccccgaaacaaaatgccccaaatcactggaatgtaagctgcactgaagcagaagctttattgtttttaattattgctatagcatcagcaactagaatagtgtttgtcacctattaggcagtcaacaaatatttgctgagtttgttaaaggaatcggaattttatcacttttttacttgattcagtagcagttatatgtgtctttggtttttcagggaagactcagaaaataggaggaactgaaattcttctttagatatttacataacttctggtacaaaaatctttttttaagattccttcaatcttcaaaattcactgaagatttgaatgatttcatcttatagagagacaaagaatcctcaaagcgagaatttgtaatgagttttgtttcatcacataaccttaaaaacacactgagtacctataataatggctgaaacaacaacaacaacaacaaaatagtgcccataccaaatgctaaaagaaagcgaagaaactatattacccgtacattgctggtaagaatgcaacatgatacagtcactctggaaaacagtctgaaattctttctaaaaaaaactaaggagacatctaacatgtcacccagcaattgcactcccagacatttatcacagagaaataaaaacttgtgatcacacaaaaacctgtacacaaatgttcatagctgctttattaataataggcaaaaactgaaaactatccatatgtccttcaataccatggaatactactcaacaataaaaacagataaactactgatacaatgaatatctttaattaatctttagataattatgctaagaagaaaaggccaatcccaaatggttacataatagatgtttccatttgtataacattcttgagatgacaaaattatagacgcgaataagagaacagtagttgccagcggttagggacaaggcaggtgagagaggtaaatgctgttataaaagagccataagggatacttgagcagttgaaactcctttgtattttgactgcagagatagacaaaggaatctacataagtgataaaattgcacagaaataaatacacacacatctacataggtacatgtatagctgtggaattctgaaaaaatgttatttgacctcacctggagctgagacaaatttagtgaaagtgaaatataggggtagagaaaacagcaggaaaagccctgtgggtactcttggtccccaagaagccattctgactttgtctcacagaggtacttgggggtgaggggagggggtctgccattgaaactggggaaagaccacagggagatggaaacttccagctgaactttgtaacaattttgattgaacacgaagtttcctggatagaacctgggggagggggcaaacctggagtttgatatgagcacagaaggcatggcaggcagggaggtacaaaatgtaaaagctttgcttgctttctcagagaggaggcttgtagcctgaggtaggttctcagccctgctcaccagctgcctgaaaataaacgtggtgccattgggctgtggtggagcatgatggcagtgcaactagcctttcagactgcatgtgagctgggtgagacctgtcactgccagatttccccactttcctggtggcctgtatgacacagcagaggcagccataatcccactgggaacataactccattgacctgggagccacacccccattcctcacagcagctgcagcaagccccgctcaaggagagtctgagctcagacacatctaacccagaccccacctgatggtctttctctgcctgtcctggtagccaaagacaaagaacataatcttttgggagctctatggccctgtccactacatgagaaacccaaatacttattcagatgacctagggcaagctggtatcctccctataccaccacagctgatgttcttttgaaagtgccacatccttgctggaggccagctaacacaaaactagcatactaaacaaagatacaaccaagaaccctaacagagtccacttcactcccctgctacctctgcaggagcaggtgctggtatccatggctgacagacctgaagacagatcacatcacaggactctttgcagacactccacagtcccaacccagagcgtggtagctccattgggtagctagatcctgaagagaaataacagtcactgtgattcaactctcaggaagccccatccctagggaacaggaaagagcagcacatcgagggaccaccccatgggacaaaagaatctgaacagcagcccttgagctctagatcttagctctgacatagtctacccaaatgaggaggaaccagagaaacaacgctggtaatatgacaaaacaaggcttattaacacccccaaaagatcacactagttcaccagcaatggatccaaacaaagcagtctctaaattgccagaaagagaattcagagggttgattattaagcttctcaaggaggcaccagagaaagatgaataccaacttaaagaaattagtttaaaaatgttacaggatatagatgaaaaaatctctggagaaatagagaccataaataaaaaacgatcacaacatctataaattcaggacacatttcgagaaatgcaaaatacactggaaagtctcaggaatataattgaacaagtagaagaaagaaattcagagatcaaagacaaggctttcaaattaacccaatccaacaagacaaagaaaaaagaattttaaaaaaatgaacaaagtctccaagaattttgggattatgttaagcgaccaaacttaagaataattggtgtgctcaaggaagaagagaaatctaaaagtttggaaaacgtatttgaggaaataattgagaaaaatgtccctgggcatgccagagatctagacatccaaatacaagaagctcaaagaacacctgggaaactcatcacaaaaaagatcgtcacctaggcacatagtcatcaggttatctaatgtcaggatgaaggaaagaatcttaagaactatgaggcaaaagcattacctataaaggaaaacctggctgggtgcagtggctcacacccgtaattccagcactttgggagactgaggtgggcagatcacttgagctcgggagtttgagatgagcctggccaacatggtgaaaccccatctctactaacaatacaaaaattagctcagcatggtggcacatgcctgcaatcccagctacttaggaggctgaggcatgagaattgcttgaacctgggaggcagagattgcagtgagctgagattgtgccactgcactccagcctgggtgatgaagcaagactctgtctcaaaaaaaaaaaaaaaaggaaacatatcagattaacagcagatttctcagcacaaaacttaccaactagaagggattgtggtcctttctttagccttaaatgaaacaattagcagccaagaattttgtatccagcaaaactaagcttcataaatgaaggaaaaatacagtctttttcaaataaatgctgagagattcaccactaccaagccagccctacaagaagtgctaaaaggagctgtaaatctgaaaacccatcctggaaatacaccaaaatagaacctccctaaagcataaatctcacagaacctataaaacaataacacaatgaaaaaaaggtatttaggcaataactagcatgagaaattgaatagtacctcacatctcaataccaacattgaatgtaaatggcctaaatgctccatttaaaagatatgaaatggcggaatggataagaattcaccaactgatatggtttggctgtgtcttcacccaaaaatctcatcttgaattatagtccccaaacccccatatgtcgagggtgggatcatgggtgtgcatttccccattctgtctcttgacagtgagtaagtctcatgggatttgatggttttataagcatctggcatttcctctgcttgcactcactccatcttgcggcaatgaaagacaatggaaaaagaatgtccccagggcatgtcagagacctccacagcagccttcccatcacaggggcctaggagggaaaaatggattcctgtgccaggtctagagcccccctgctatgtgcagcctcaggacttggtgccctgtgtcccagcttctccagctgtggctaaaaggggccagggtacagctcagatcattgcttcaaagggtgcaaatcccaaaccttggcagcttccacatggtgttggtcctgcaggtgtacagaagaccagaattaaggttcgggaccttctcctagatttcagaggatgtatggaaatgcctggatgtggaggcagaggtgtgctgcaggggcagagccctcatagagaacctctgctagggcaatgagaaagggaaatgtagggttgtatcccccacacagagtccccacatgagcactgcctagtggagctgtgaaaagaaggccacaatcctccagaccccaggatggtagatgcaccaacagcttgcaccatgccccttgaaaacctgcagatactcaatgccagcctgtgaaagcagccaggagggggactgtaccctgcgaagctaaagggatggagctgcccagggccatggggaggccacctcttacaacagcatcacctgactgtgagacatggagtcaaaggaaatcattttggagctttaagatttgactgccctgttggattttggaattgcttgtggggcctatagcacctttgttttgataaatttctcccctttggaagggtgcatttatgcaatgcctgtatccccattgtatctaggaagtaactaacttgcttttgattttacaggctcataagtgaaagggacttgcctcgtcttatatgagattttggacttggacttttggtttattgctagaatgaatgaagacttcatgggactgttgggaaggcaagattgattttgaaatgtgaaagggacatgagattggtggggggagtagggactgaataatatggttaggctttgtgtccccacccaaatctcatcttgaattgtaattcccaaaatcatgggaagagataactgaatcatgggggtggttcccccatgccattctcatgatagtgagtgagttctcaagagatatgatggttttataagtggctcttcctcctttgctcagagcttttcctttctgcggccttgtgaagaaggtgccagcttccccttcaccttctgccatgattgtaagtttcctgaggcctccccagtcacaccgaactgtgagtcaattaaacttctttcctttataaattatccagtctcagccagttctttataacagtatgaaaacagactaatacaccaactaagcatttggtatcttcaagagattcaactatcacataatgactgatataaagtagtataaggtaaaatggtgaaaaaagatattgcatgcaaatggacaccaaaggtgagcaggggtaagtattcttatatcagacaaaaccaactttaaagcaacagatgttacaaaaaaaaaaagggacattatataaagattaaggaacttctccaagagaaaaatatcaaaatcctaaatatatttgcacctaacactggatcacccaaatttataaaacaattagtactagacctaagaaatggaatagacagccgtacaataatagtggggggacttcaatactctactgacagcactagacagatcatcaagacagaaagtcaacaaagaaacaatggactattacctagaataagtgaacttaagagatatttatagaacgttctacccaacaactgcagaatacacattctattcatcagcacttggaacattctccatgatagaccatatgataggccacaaaaatctctcaataaatttaagagaattaaaattctatcaaatactctctcagactacagtgaaataaaatttgaaatgaactccaaaaggaaccctcaaaactatgcaaatacatgaaaattaaataacctgctcctgcatgatcactgggtcaacaatgaaatcaaggtggacatttaaaaattttttgaactgaatgataatcatgatacaacccttgtgataaagcaaaagcagtgctaagaggaaacttcatagcattaaatgcctacatcaaaaagtctgagagagcacaaatagacaatctaaggtcacacctcaaggaactagagaaacaagaacaaaccaaagccaaacccagcagaagaaaagaaataaaaaagatcagagcagaattaaatgaaattgaaacaaaaaatcaaagaaacaatgagcaggttatttgaagagataagtaaaatcaatagatcattagtaagattaaccaagaaaagaagagagaagatccaaataagctcaattagaaatgaaatgggagatattacaaccgatactacagaaatacaaaagatcattcaaggctactatgaacaccttgatgtgcataaactagaaaacctagaggagatgggtacattcctggaaatacacaaccctcctagattaaaccaggaagaaatagaaactctgaacagaccagtaacaagcagcaagattaaaatggtaataaaaaaaaatgccaacaaaaaagtccatgatcagacagatacacaactgaattttgtcagacattcaaagaagaattggtaccaatcctactgacactatttcaaaagatagagaaagatggacactattccaaaagatagagaaagatggaatcctccctaaatcattctatgaagccagtatcacaccaataccaaaacctgggaaggacattacaaaaagaaaactattgaccaatatccctgatgaacacagatgcaaaatcctcaacaaaatactagttaaccgaatccaacagcatgtcaaaaagataatccaccatgatcaagtgggtttcataccagggatgcaaggatggtttaacatccataagtcaataaatgtgatacaccacataaacagagtcaaaaacaaaaatcacatgatcatctcaataggtgcagaaaagacatttaacaaaatccagcatcccattgtgattaaaatcctcagcaaaatcagcatagaagggacatatcttaaggtaataaaagctatgtatgacaaacccacagctaaccttatactgaatggggaaaagttgaaagcattccccctgagaattggaacaagacaaggatggccactattaccacttctattgagcatagtactgaaagtcctagccagagcaatcagacaacagaaacaaacaaaaggcacccagtttggtaaagaggaagtcagactgtcactgtttgctgatgatatgattgtatacctagaaaaccctaaagactcatccaaaaacctcctagaagtgataaatgaattcagcaaagtttcaagatagaaaacacattgaaattaaaataaaagatgttaccattgggagaaactgtgtaaagagttcacaggatctctgcattttcttacagcttcatgtgaatctgcaattatctcaaaatgaaactaatttaatgtctaatccttaggatgggggagggggaattaacagcaactaccagataagaagcttctatatttttcctgaagtaagtagttaatggtaacttcattatttcttttttttctctttctttcaattttttaaaaaggtttctttagttacaaaacagttatgcatattgtgaacaagtaaataaagaagtgtgtaaaaacatgtttgtaatctcttgctttctgactcccatccccttgacccccaagtaacagtaacaggttttaatacttttggatatatccttcaacacacgtatctatgctcatacaagcatgtatacacacatgtacttatatgtagcactttataaacagatttaacaacataatattccttagtagagatgtaccataattctggtacataaatagtagttttcccattttcctgtagatacttggttaaaaaaatatgctgtaacaaatatgcttttatctttgtccttacatctcagtagtttcatttttatagaacagtttcccaaggaggttattttgtcaatacattcatttttttttaatggttattggtcatattttgaaaagctagttacacaacactgaacactacttacgaggatatccctcttgtgcgtgaggtctttataactatctaagaaaaattagaatggctgggcatgttggttcatgcctgtaatcgcagcactttgggaggctgaggtgggcggatcacttgagctcaggagtttgagaacagcctggacaacatgggccccgtctctacaaaaaatacaaaaaactcactcagaatagtggcacatgccagtagttccagttacctgggaggctgaggtgggagtatcacctgagcctgggaagtcgaggctgcagtgagctgtgataataccgacaataccagtgcagtccagcctgggtgagatacagtaaaaccctgtcccccggcctgctaaaaaaaaaaaaagtaaagaaaaaagaaaatgtagaatgaccaaactatagtcaggtacttataagtgtgatttctgtccactcagagaaaaaaagacctgaatttcagcattttatctcaatagtacatttaaaaatatgcctatacttgcttttaattctttacaagactgcgttatgataaattattggtttcttttacatctaatattatggggttcaatccttcttataaaaacttacagatttatgacaggcatagtggtttatgccttaatcctagcagtttgggaggccaagccagggggatctcttgggcctaggagtttgagatcagctcaggaaacatagggagaccccatctctacaaaaaatttaaaaattagctgggcatggtgccatgtgcctgtggttccagctacttgggaggctaaggtgggaggatctcctgagccgggaggtccaggctgcagtaagccatgatcacaccactgtactccagcctgggcaacagagtgagacccagtctcaaaaagaaaaaaacaaacaaacaaaaatgtacagatttaatatttttaataaaatttaattttaattcataagtactctaaaaagctaagaaatttgagtatggtacactatttccattattattatgttttaagatatatttgttgttcacttgaactttccatttaaaatagcttttatcgatagtacccagtattagcaaaagtgcaaggaatttcattgcttggtagatacttctagaaaataattcataaattatttgacaaaaaatagccgtgcaaatgttcatattttaacacagtaactctacttctgaaacttttataagtgaatagttacaatgtaaaagtaaattttagaaaaaaaattaatgagatggggaaatgtccatgatacattgctaaatgaaacaacagtttttaaagatatattaattaagcttcttttgatattgaagtaaataaaacccactcccattcaattaagcaaattggaaatataccaaaagaatgaaagtcaggaatttagccaagccttgtaaatacactaattgtggctgcacagtagtgaagacattttccctgtttctgtatctcctcctttcttctggcctgtcttacttttctcccctgctgcatcctgccttcttccaccttctactgtacatgtcagaaaatgttggtttttcctctatccaatagaccaaggagtgtgaagctggaatctgttctttccaaatccaaatcccctagagaaagatctcattcagctttcttggatcagttgctaatctgtgtgagtatgggggtgggggaataaagaaaagttatatgaatatagatacatagagtcttgcctcaagatttttatgaatagaaaaaatatatgtatatgtttatagaggacatctacggagtgctgcccagcacttccgtaatgcataatatgtatatcaatacagagaaatctatagatattaataaagattatgctacatatgaatatatataaaacatctaaacgctaagcaaatattatctattattaaagtgatgtgattttaatttcttctttattccctatactttcaattttatcaataaatatgaatcacttttaggatcaaagcaaatatattcaaatatgtatcaagtaaaattaaataggtatagaaaatacataagattcacaatgttatggtcatttattgtttcataaatagatgttctgaaaccatgcttgcaaactttaaattaaaccaattcaaaatatgcaaaaatttttaaagtaaatgccaatttaatgaaatgcaaaatttcataaacacaaagggttattatatatggtaaaacaaaagtggaccgggcgcagtggctcccgcctgtaatcccagcactttgggaggccgaggcaggcagatcacaaggtcaggagattgagaccatcctggctaacacggtgaaaccccgtctctactaaaaatacaaaaaaaaattagctgggcatggtggcaggcgcctgtagtcccagctactcgggaggctgaggcaggagaaaggcatgaacccaggaggcggagcttgcagtcagccgagatcgcgccactgcactccagcctgggtgacagcgcaagactctgtctcaaaacaaaaaacaaaaacaaaaaaacacaaaagtgttcttcagttaacattcactttgttaatatgcagaaataggaaataattttaattactgaaaattactaaattatgctgaaaaataaacttaataaagcattttagagatgtaagtgctatatattttcctaggattataagtactaatcgtatctagaaaattaacataacaattattttttggcttatttccacccacgttttagaaagaaaatataatatttcttttaaaatctttaaaaggctttcaaaagccacatgtgtgtatatatatatatatacgtatatatatatatatatatatatacgtatatatatatatatatacatatatatattttttatactttaagttctgggacacatatgcagaatgtgcacatttgttgcataggtatacacgtgccatggtggtttgctgcaccaagcaacccatcatctacattaggtatttctcctaatgctatccctcccctaaacccccaccccctgacaggccatgatgtgaggtgttccccactctgcatccatgtgttctcattattcaactcccacatgcggtgtttggttttctgttcttgtgatagtttgctgagaatcatggtttctggcttcatccatgtgtttcaaaggacatgaatgcatccttttttatgtctgcatagtattctatggtgtatatgtgctacattttctttatccagtgtatcactgatggacatctgggttgattccaagtctttgctattgtgaacagtgctgcaataaacatacgtgtgcatgtgtctttagattagaatgatttataattctttgggtattatacccagtatatacttgggtatatacccagtaatgggattgctgggtcaaatggtatttctagttctagatacttgaggaatcgccacactgtcttccacaatggttgaactaatttacattcccccccaacagtgtaaaagcattcctatttctccacgtcctctccagtcctctgttctttcctgactttttaatgattgccattctaattggcatgagatggtatctcatcatggatttgattttcatttctctaatgaccagtgatgatgagctttttttcatatctttgttggccgcataaatgtctccttttgagaagtgtctgttcgtagccttcgcccactttttgatggaattgtttgtttttttcttgtaaaattgtttaagttctttgtagattctggtatcagtcctttgtcagagagttagattgcaaaaattttctcccattctgtaggttgcctgttcactctgataatagttacttttgctgtgcagaagccctttagtttaattagatctcatttgtctattttggcttttgttgccattgcttttggtgttttagcaatgaagtccttgcccatgcctacgtcctgaatggtattgcctaggttttcttctagggtttttatggttttaggtcttacgtttaagtccttaatctgtcttgagttaatttttgtataaggtgtaatgaacggggtcccttttcagttttctgcatatggctaaccagttttccaaacaccatttattaaatagggaatcctttccccattgtttgtttttgccaggtttgtcaaagaccagattgttgtagatgtgtggtgttatttctgaggcctctgttctattccattggtctatatagctgttttggtaccagtgccatgctgttttggttactgtagccttgtagtacagtttgaagtaaggttgcgtgctgccttcaattttgttcttttcgcctaggactgtcttggctaccctggctcttttttggttccatatgaaatttaaagtagttattttctaattctgtgaagaaagtcaatggtagcttgatgggatagcattgaatctataaattactttgggcagtatagccattttcatgatattgattcttcctatccatgagcatgtaatgttttcccatttgtttctgtcctctcttatttccttgagcagtgatttgtagatctccttgaagaggtccttcacatcccttgtgggttgtattcctatgtattttattctctttgtagaagcaattgtgaatgggagttcacgcatgatttggctctctattattgatgtataggagtgcgtgcaatttttgcacattgattttgtatcctgagactttgctgaagttgtttaacagcttaaggagattttgggaagagacaatgggattttctaaatatacaatcatgtcatctgaaaacagagacaatttgacttcttctcttcctatttgaacaccctttatttctttctcttgcctcattgccctggccagaacttacaatactatgttgaatacaagtggtgagagagggtatccttgtcttgtgccagttttcaaagggaatgcttccagtttttgcccattcggctgtgggtttgtcataaatagctcttattgttttgagatacgttccatgaatacctagtttattgagagtttttagcatgacaggctgttgaattttttctaaggcctattctgtgtcaattgagataatcatgtggtttttgtcattggttctgtttatgcaattgattacatttattgatttgcgtatgttgaaccagccttgcatccaaggcatgaagccaacttgatcatggtggataagctttttgatgtgctgctggattcagtttgccagtattttattgaggatttttgcatcgatgttcatcatggatattggtctgaaattttctttttttttgttgtgtctctgccaggttttggtatcaggatgatgctggcctcataaaatgagttagggaggagaccctctttttctattgattgaaagatagtttcagaaggaatggtaccagctcctctttgtacctctggtagaattcagctgtgaatctgtcttgtcctgggcttttttttgattggtaggctattaattactgcctcaatttcagaacttgttattgttctattcagggattcgacttcttcctggtttagtcttgggagggtgtatgtatccaggaatttatccatttcgtctagattttctagtttatttgcatagaggtgtttatagtattctttgatggtagtttgtatttctctgggatcagtggtgatatcccctttatcattttttattgtgtcttttttattcttctctctcttcttctttgttagtctggctagcggtctattttgttgatcttttcagaaaaccaactcctggattcactgattttttgaagggttttccgtgtctctatctccctcagttctgctctgatcctagttatctcttgtcttctgctagcttttgaatttgtttcctcccgcttctctagttcttttcattgttatgtttgggtgtcgattttagatctttcctgctttctcctgtgggcacttattgccatacatttccctctataaacagtgctttagctgtatcccagagattctggtacattgtgcctttgttgtcattggtttcaaataacttatttgtttctgccttaattttgttatttacccagtagtcattccggagcaggatgttcagtttccatgtagttgtgtgattttcagtgagtttcttaatcctgagttcaaatttgattgcactgtggtctgagagactgttatggtttacattcttgtgcatttgctgaggagtgttttacttccaattatgtgatcaattttagaataagtgcaatgtgttgctgagaagaatgtatattctgttgatttggagtggagagttctgtagatgtctattaggtcagcctggtccagagctgagctcgagtcctgaatgtccttgttaattttctgtctcattgatctgtctaatatcgacagtggggtgttaacatctcccactattattgtgtaagtgtaagtctgtttgtaggtctctaagaacttcctttatgaatccggttgctcctgtaagggatgcatatatatttaggatagttagctcttcttgttgcattgatccctttaccattatgtaatggccttctttgtcttttttgatctttgttggtttaaagtctgttttatcagagactaggactgcaacccctggggtttttttttgtttgtttcccatttgcttggtaaatattattccatccctttattttgagcctatgtatgtctttgcacatgagatgggtctcctgaatacagcacaccaatgggtcttgactctttgtccaattttccagtctgtgtcttttaattggggcatttagcccatttacatttaaggttaatattgttatgtgtgaattttatcctgtcattatgacgctagctcattattttgcccactagttgatgcagtttcatcatagcatcaatgttctttacaatttggtatgtttctgcagtggctggtaccagtttttcctttccatgtttagtgcttcctttaggagctcttgtaagcaggcctggtggtgacaaaatctctcagcatttgcttgtctgtaaaggattttatttctcctttgcttatgaagcttagtttggctggatataaaactctgggctgaaaattcttttctttaagagttttgaatattggcccccaatctcttctgacttgtagagtttctgcagagagatctgttgttagtctgatgtgcttccctttgtgggtaacctgacctttctctctggctgcccttaatatttttcccttcatttcaaccttggtgaatctgatgattatgtgttttggggttgctcttcttgaggagtatctttgtggtattctctgtatttcttgaatttgagtgttggcctgtcttgctaagttggggaagttctcctggataatatcctgcagagtgttttccaacttggttccattctccctgtcactttcaggtacaccaatcaaacgtaggtttggtcttttcacatagccccatatttattggaggctttgtttgttccttttcattcttttttctctcatcttgtcttcatgctttatttcattaagttaatcttcaatctttgatatcctttcttctgcttgattgatttggctattgatatttgggtattcttcatgaacttctcatgctgtgtttttcacctccattaggtcatttgtgttcttctctaacctggttattcttgttagcaattcctctaacccttttttcaaggttcttagcttccttgcattgggttcaaacatgctcctttagctcggaggactttgttattacccaccttctgaagcctacttttgtcaatttgccaaactcattctccatccagttttgctcccttgctggcaaggagttgtgatcctttggaggagaagagatgttcttgtttttttaattttcagcctttttgcactggtttttcctcatcttcatggatttatctacttttggtctttgatgctggcgacctttggatggggattttgtgtggacttcctttttgttgatgttgatgctattcctttctgtttgttagttttccttctaacagtcaggcccctctgctgcaggtctactggagtttgctggaggtccactccagacgctgtttgcctggttatcaccagcggaggctgcagaacagcacagaatgcttcatcccagatgggcacctgtcagatgccagccggagctctcctgtatgaggtgtctgttgacccctgctgggaggtgtctcccagtcatgagacatgggggtcagggacccaacttgaggaggcagtctgtcccttagcagagctcgagtgctgtgctgggagatctgctgctctctttagagctggcaggcaggaacatttaagtctgctgaagctgtgcccacagccacccctttccccaggtgctctgtcccagggagatgggagttttatctataaggccctaactggggctgctgcttttctttcatagatgccctgaggcagtctggctacagcagcattgctgagctgtcatgggctctgcccagtttgaacttcccagtagctttgattacactgtgaggggaaaactgcctactcaagcctcagtaatggcggatgccacttcccccaccaagctcaagcatcccaggttgacttcagactgctgtactggcagggagaatttcaagccagtggatcttagcttgcttggctctgtgggggtgggatccactgagctagaccacttggctccctggcttcagcccccttttcaggggagtgaatgtttctgtctcgctggtgttccaggtgccactggggtatgaaaagaaactcctgcagcttgctcactgtctgcccataagccctccctgttttgtgcttgaaacccagggccctggtgatataggcacctgagggaatctcctggtctgcaggttgtgaagactgtgggaaaagcatagtatctgtggctggagtgcactgtctctcatggcacagtcccttggggcttcccttggctagaggaaggagttccccgaccctttgcacttcccgggtgaggtgacaccctaccttgcttcggctcaccctccatgggctgcacccactgtctaaccagtcccaatgagatgagctgggtactttagctggaaatgcagaattcacctgccttctgcgtcaatctcactgggagctgcagactggagctgttcctatttggccatcttgccagccacttctccaatgccttttagacagtaagtacaaagtatttaggcagtatttagtaaacagacagtaaatacaaagtataatttggaaaatctgtgcattgcactatagcttcttttgctcattttcagtaagtcttcattaaagtttaaactgaatgttctctaactgttagagttctctaagtaatagaggccaaaagtcagctgaaataagaagattgactcccagaatgggaaattattcaagacgtctgatgatcttgactaatgatttcagttatttaaaaatactttgataattttagtcattgattttgaaaatataaaatgctgttttttatacccgtagcaatatattgcaataagaagtatgtaaactgacttcttgattgatacaaccataattgaattacattcggtgaaatcaccagtttaataactcattgcttttgtgacttcccttttgataaaatggagatcctacctcttggtcacccatgtaatataacattaagtttcccctaagagcctgtgattgcccttagaatgcctgtgccaagcaggcttgataaggccctcactataaaggaatagattacattttgccaaattttgcctgcatccatgaataaagaactgcataattttgtcttggaattgtcaaggatcatatagatgtttgagtagttttgagatcatctaaggactgtgattatctcagaaaagcacttaagtcttttgaaggaaaataaaactgataaaatctctccatagaatattttgagttagaggtaggaggaaggaagacagagtctgaaaatacaacccccaaaagatgtagcatgtagaatgtaggaaatttcccattccatccaccaatccccttcaccatgtgcatcccctctaacattctgatatatctacacaaaaaatgtaatagaaccaggagctggataaagtcatctatgcacactctaaaatataaagcatggtttgattctatatgatatgctatatgttgctagttttccttcaaattggaaattaaagtaaaattacaaactgtatctcatgaaagacatactgttaccatcttcacaagtgttttctacactctactgtgcctttttttcatcctatcttctgcctcttccccagaatactttccttttctgaggctggagaacaggagtggctgtgggtgatttttgtacctttttacctctagtgaagggatatctacacagaagtacccaaagcttttactctgatatctgaataacaggaaaagctaaaaagtcgtatagggacacatgaagctagaggaagggattatacaggtattgaattcagatttcttttctgtaccacaaaagacagattgatggcagaatcccggaagtcactggccttgagcccagagttgagcttagccaaggggcccaacagtgaccttgactacaggtctaaaatcaagtaggtctgagaatggaaaaacactgaatctcctcagcaggatcatatgttttcacaaactctcagcacatagtttgagttcttcttcctattagctacaaaatcctgggtaggtgtgatcactagacagtttctttcaaggagcctattagagaaataacattttgtccatcaatgctactgggaaaaagtaaaaatatgccattgccctacatcaatggttaaaaaaaattaaaaataactcagtaagatggaaatgctagaaatagaaaacctttctatgaagtttaatgcctgcagtgcttaaaattactcattaatccaatttgcagagttggtaatctgattaaataaagctcttatttagatatgaactaaattcctccatctgctagaaaacaactatcatttaagttgctttttcattgaaatgtgtctatttcaggtcttataaccactaatatgcttgaatcataaaatgaaaaagcctaacatttcatgtaagataacatttccccaacacgcaaaatattttgcaatgtgatcctcttcttagttgaaaaatcaaactttggtttacatcagaagaagtatgaataatgaaattgctatatagtaagcttgaaaacagatcagaacagaaaaaggcaaattgggaagagaggatgccctaactagactacttcaatccaatcctattgcctgcataagtgttcattagtcttagagttcagagcaccaggaccacgtatggcctccctccttcccctgctcttaatctttatttctatctttctcatccagatacaataaaaataactaaaatgcattattaggtgattatttcatgcaagttattacattaaatacttattaactaatttaattctcacaaaatccccatgaggtagatgctcctattatctctactttaaagataagcaaactgaatacacccatgttagtagcaacattatttgcaatagacaaaaggtagatgcaacctaagtgttcatcaagtgatgaaaggataaacaaaatgtagatatggacaacggaatattattcagccttgaaaaagaaggaaattctgacacatgcatgaaacttaaggacattatgttaagtgaaataagccagtcacacaccaaaaaaactactatatgatcccacttgtatgaagtatctagaacagtcaaattcataggactgaaattagaagggtggtttccaggggctggggagagtaaggaagggagatttattgtttaatggatatagagtttcagctttgcaagatgaaaagagatcagaaaattcgttgcacaacaatgtgaatgtacttcacgctactcaatgatacacttaaacatgattaaggtcataaattctatgttatatgtatttctatgttatatgtatttgtttttttgagatggagttttgctcttgttgccgaggctggggtgcaatggtgtgatctcagctcactgcaacctccactgccttggttcaagtgattctcctgcctcagcctccagagtagctgggattacaggtgcccaccagcatgcctggctaatttttatatttttagtagagacggggtttcaccacgttggccaaactgagtttgaactccttacctcaggcactctgcccgcctcagcctctcgaagtgttgggattataggtgtaagccactgtgcccagcctgttatatgtaattttaaaataagcaaactgagacacaaagaggttaagcaacttaacttcactcagttctgtgtttcacatggaatactacacagccataaaaaagaacaaaattgtgtcctttcagcaatatggatgtagctggaggccattatcctaagtgaattaaagcaataacagtaaaccaaatattgccttttctcacttaaaagagggagctaaaccttaggtatgcaaggacataaagttgtgaagaagagacactgggagacactgggggctccaaaaggagaaagggagggagggcagcaagggcttaaaaacttcctactggggccaggtgcaggggttcacgcctttaatcccagcattttgggaggcagaggcaggcagatcagctgaggtcaggagttcgagaccagactagccaacatagtgaaaccccatctctactaaaaatacaaaaattaaacaggtgtggtggtgcctgactgtaatcctagctacttgggaggctgaggcaggagaatctctttaacctgggaggcagaggttgcagtgagccaagatcgcgccactgcactccagtctgggctacagagtgagactccatctcaaaacaaaacaaaacaaaacaaaacaaaaacttcctactggatattatgttcactatcttgcttatgagattaatagaagctcaaacctcagcatcacacaatagacccttataacaaacctgcatatgtaccccaaaatctaaaattaaaattgaaattgaaaaaataaaataaaacaaaggaattctgtgtttctacagatggcatattaaaatggctttaatataaaaattgatttttaaaagtttaaaagaattatggttgtacaaggagtcactcctgtagaacataactttcattcagacaccgaagccataatctggacgttttcttctttttttaaaattttgttttgtggggggacattttcttaacatcaacataatttcctctccttcatgcccaacttccagtcagtcactgattcttattaatttaaccaataaaaatatctcttatttctgtctcttcctttcttttcactacttccactgctttagtcaacagggaccattgcaatcactctaacctgtctctctgtatccaccaagactcttcattatagaagtatctcatcattccccagtctaatatcctgcaaagccaccccctttgaatgaatgaaacaaaaaagtccttcacatgacatatacggtcttgcaaagaacttattttgtgtctaccatctcatctcatgccactgtctctgttccataagctctggacataaccaacactttagaggtgacaaatagaccaggttgctattaaatttctcaatctttgaacaagctgtttcctctagctgtaattgctcccttgctctctccaccacaaaatatttctactcattctttaaaaattatttcacaagtgtctaggccgggaagccaaacttgataaccaggattgcaaacgactccctcaaaatgatttaatagtatttatagaatgtcattataattatttgtttttgtgtttgtcccatgagtttatggctccttaaaagtggtcaaaatgtctttttctgtcactatggctgccatctagcccagtgactaccatataaaataagtgcttgaatgcatgagtgaacacaaaatcaatgaattaataaattaatggttattcagcatgagtcccagcactatagtcaacaaaagagccacatcttcctgttggaatgtgggtcactgattatataggctagtccctggattgcagaagaaagtggataatattgaataattcttctatattttccatctcattaaggagactagagacttgctcaaaagaatggaagacttatttagccccaaaagcataaaaagaaacagaatctaggaataagataattcacagccagactcaagggttggtcactagaaaaaatagtttgacagactagaaaaagtgaaaaaaattctacattgaactactggagcaacacaacatatttgagactgtttccacagaggttacagctagattcttcacaatagaacaaatgataccccattcttcaaaaaaatcattaaaaggatgctgggcccctgaaaattctgaatatcattactgatctaaaaaggaagaggtgtaccttagtaacttacagcttcctgctgagaaacacaaaaacagcagaacaaaaaactgctgtggccaatcaggaggtgagatatgttgctgtaccacatataagaagtatgaataaaaaccattattattaagcaaacccgccaacggctatcaattgctgctgatgccagctcacatgggaaggtttaactcaaacaaaatagaggatgcatctctataaagtccctgctggaaaaactggaggacttgagggcatatgcagcattttctttttttccatttgaaggtcatgactttagaaagaaactaataatgaggttgaaaagtagcttgggtcagagcatggagcaaagaagtccgacagatttggaatttacccaataagcaattaggagtcattgaagttctttgtgaagggaagtaaatttgcattccaatgtttaaattagactcatgtacatcgaatttatggaatcaattaagtgtgacataatgcacctagaatctactaaaactaaatcatgttctaagacttgaaagacaaagtactaaattttgaataataataactgtactaagcttcattgaaccttggaatcattggccaaatgttctttagttcactgtccatcacattttgtatttttttaatccacagtgcctaaagggtacttataaatagcaaatgtacatcaaatttctggcaagagtgatgtaggagggtgagaatggtgctcagtacccctctgaaaagttacatctaaatctccagtccattgttcctactaataagggtactaaaatagtagcaataataataatagggttataacacatgtgggcacatatctacatgtcttttacgaattacatattgtaataaggatgaatatggtttctcagatttggagaatacatttggggtattcttagggtcgggcacagtggctcacacctgtaatcccaacactttgggaggctgaggcgggcggatcacctgaggtcaggagtttgagaccagcatgcccaacatggcgaaaccctatctctacaaaaaatgcaaaaattagccgggcatggtgacatgtgcctgtagtcctagctatttgggaggctgaggcaggagaattgcttgaacccgggaggcagagggttgcagtgagctgagactgtgccactgtgctccagcctggacaacagattgagactctgtctcaaaaaaaaaaagtatatatacatatatacaaacatatatatatatacacacacatatatacaaacatatatatacgcatatatgtatatataaccatatatatatacatatatatgtatatatataaacacatatatgtttatatataaacatatatatgtatatatatacatatatgtatatataaacatatatgtatatataaacatatatgtatatataaacatatataaaatatataaacatatatatagaaactatatatatatatgtttataccacgaagttttctttagggggacctcaaagtaataccaaggcataacaagatgtttatatgcctgtcagctggaaaaaaatgccatttttttttttttactatactttaagttctagggtacatgtgcacaacgtgcaggtttgttacataggtacgcatgtgccatgttggtttgctgcacccattaacttgtcatttacattaggtatttctcctaatgctatccctccccctgtcccccaccccatgacaggccccagtgtctgatgttccccaccctgtgtccaagtgttcacattgttcaattcccacctatgagtgaaaacatgcagtgtttggttttctgtccttgtgatagtttgctcaggatgatggtttccagctgcatccatgtccctgcaaaggacatgaactcatccttttttatggcctcatagtattccatggtgtatatatgatgcattttcttaatccagtctatcattgatggatatttgggttggttccaagtctttgctattgtaaacagtgccgcaataaatatatgtgtgcatgtgtctttatagtagcatgatttataatcctttgggtatatacccagtaatgggacggctgggtcaaatggtatttctaattctagatccttgaggaatcaccacactgtcttctacaatggttgaactagtttgcactcccaccaacactataaaagcattcctatttctccacatcctctccagcatctgttgtttcctgactttttaatgatcgccattctaactggtgtgagatggtgtctcattgtggctttgatttgcatttctctgatgaccagtgatgatgagcattttttcctgtgtctcttggttgcataagtgtcttcttttgagaagtgtctgttcatatcctttgcccacattttgatggggttgtttggtttttttcttgtaaatttgtttaagttccttgtagattctggatattagccctttgtcagatgggtagactgcaaaaatcttctcccattctgtaggttgcctgttcactctgatggtagtttcttttgctgtgcagaagctctttagtttaattaggtctcatctgtcaattttggcttttgttgccattgcttttggtgttttagacatgaagtccttgcccatgcctatgtcctgaatggtattgcctaggttttcttctggggtttttatggttttaggtctaatatttaagttgttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggtaatatttctgaggcctctgttctattccgttggtctacatatctgttttggtaccagtaccatgctgttttggttactgtagccttgtagtatagtttgaagtcaggtagcgcgatgcctccagctttcttcttttttctttggattgtcttggcaatgagggctctttgttacttccatatgaactttaaagtagttttttctaattctgtgaagaaagtcattggtagcttgatggggatggcattgaatctttaaattaccttgggcagaatggccattttcacgatttgattcttcctatccatgagcatggaatgttcttccatttgtttgtatcctcttttattttgttgagcagtggtttgtagttctccttgaagaggtccttcacttcccttgtaagttggattcctaggtattttattctctttgaagcaattgtgaatgggagttcactcatgatttggctctctgtttgtctgttactggtgtataagaatgcttgtgatttttgcacgttgattttgtgtcctgagactttgctgaagttgcttatcggcttaaggagatttggggctgagactatggggttttctaaatatacaatcatgtcatctgccaacagggacaatttgaattcctcttttcctaattgaataccctttctttctcttgccgattgccctggccagaacttccaacactgtggtgaataggagtggtgagagagggtatccctgtcttgtgccagtgttcaaagggaatgcttccagtttttgcccattcagtatgatattggctgtgggtttgtcataaatagctcttattattttgagatatgtcccatcaatacctagtttattgagagtttttagcatgaaggctgttgaattttgtcaaaggcctttacttcatctattgagataatcatgttgtttttgtcgttggttctgtttatgtgatggattatgtttgttgatttgtgtatgctgaaccagccttgggaaatgccatatctttcaaagatattctagatataaataaatatgagttcatatttcaaattgaaagtctcaacagtaagcattcttaatagcaaaaactatatttgattgatctgcttgttattcatacaattccatatagtttgatccagagatccaggattttgagtgcatgtttgtttttttattttacagcatttaatgagtctccaaagcaacctcagtgagattagagtaatatgtgtttaacacactgcttccagaaaagatgcttatcataggaactctgaatttttatgtttcggaaacattgcccagtgaagccaagggaccagaagggccaggattgtggtataagataaaccatttgacagcggaagtattactgcccaacatttatcacaataacagttcataggtatacagcacctgctatatgccaggtactattctaataaagagaatagatagatagttagatagacagatagatagataggcatttatttaatctccacagatagcaaatgtgattttcataagaccgtataaactagagacttaccacttacgctttacagaagaggaaatagaggcacaacattctcttctaccaaacttcgatgccacttctataaaacataaaccccttttccccttgtttttacttgtgtagcaccctctaactgcctctattatagggtttctcatagtacagtaaaattttacatatgtatatgaccacgtgttactctgtgtatgtgtacagtaatataacccaaaactctctatgagcccaccctgcacaagaataaagaatactctatatatttttgcccccatcactcctaacagagggactcaatatatggtaaacactcaataaatgtgtgctagtgaaaactcacctgaactccctggctgctgttcactactattgggtacacctgcctgctcagctggcatttgttctgtctttacaacagttgactttcaccttcaacttctgaaccttggtcttcaaactcctttcagattgctaggcctggatcataattattaataatataatgtctgctagcacaaacacaacaaaaataattataataacaataatgacaggagctaatatttattgagcatcaacaaagatttcagtctttgttaacctgggctatcctagtgcctgggttgtatgcaatgcagatgattttggtcttaggcaagctccatatgctgtggaattgtctaaagaagaaatctaaaatgaaatatttattcggtaaaatatttaatctaaaaacacctaaaactgtagttctttgctttataagagaaactacaactttttaaaatttttatcaaaccacagattcttcttttgcatcttagaatatcagctgtggccagaaattcattaaattgaatgcaaaatcctactgtgtataattttagttaacatttcaacctacctttggaatgcaattaaggggcagtaacaatttatctcaatataatgacttctggctcttataaaaaaactattaaagaatgagaacaagagctttcttcttcacaattaatatttactaagtctccagggctgaaatgacctcagtctttttcttcaagtctacaatcacagctgcagtttttttccattactatagcaaccacaggaatgcaagcattgtacttccttctctgtccaaaacatataaaaggggccagagtagcaacaaccaccaggagacagataaatgcccttaaaatgatcataattaagaatttacatttatgggagtattttgaaagcacatctgacttcagagtacttatatcattcaactatgaccaaatacatattcatttaggtttattgaatcaagattcattagtttcaattacagaaactttctacaaaggaattctaaatttaccagttttgtcttttcatctaaacaaatgatagaaaaagttctcctccattaaggttatagagaactttttaaattacataaaaatgatgtcttatttatacctaaagggagctagaaaaggaccaaaatataagaagttagtggtttaatccctaatttgttggttatacttcaaaatcatagtaatagtaaggacatgtctgtatgcctatatttgtgtctttaatctaagtaattacaaagtaacaccagcacagtattctaaaaagatgtcagtggaactttcaaacacatgactcccattctgtatatctacagttagataactttggaagtcccaggcccaattttgctatattagaacacactttaaggtgaaagacccgcggaacaagtaatagcattcttcattataaatacaatgactttaagctttggacatagacacatctctagaattggttggtatattatacatatggggaaacagaggaggaaaagatttcgaatatttccctccaccatctattcgaacctctttttgaaaaaagaagacactgattcaaagataaaataatgaatacatagacaattagatgacagacagaccagatagatagatagatagatagacagacagacagacagacagatagatccccgtagatcccagttgacacaaagggaggtttctattacttagcaattttttccttttaaatttgaaaaatgagactgctactctattccttttctaaagaaacacatactaactacttgcatttgtcctgtcaaatttttcaagggctctttcttgggagctgggctcctacctcaatgtgtaaaacttgctgggatatgtgctacattagacgtattaagagcgcacagtggaaacacataggatgagtctcatttttccgggagcagttgcacagagcaaggactgtttttgtttaggattaaacatatttcattcagccgcacagggagcagtgtggaggaaatatgctggaagatggaatcagaagagtgagcatgagatcattttgcaaagggccttgaatgccatcctaaagagtctggactcctgagggtaacaggaggactctctttaagcaagacagtggctctattaaaaggataaatggggagatgacgtgcagtgcggagagatgattaaacaggaagtctgttgcattaaacaaagaaattaaatagaaaagttacggtgaaatagaggagatggattagaaaggtatttagaaaaaagacttcacaggactcaataatatctaacacatctaagagtgaatgacataactagttgaagataactgtgccaaattctaattagagaaacacgtagggcagaaacagtgagtcatatttaaacttatcgatgtgtcaacacaattgtgcaggtgttagcttctctactttgaagtatcctccaatctatgccctgtctttgccaactagatcatcacgatagttgtaaaaagcagagttagtttaacatctctgctcgtcttctctcaatttttatagaaagttaaaaacacttaacgaagtagtccatgtaaaaataccatgaaaaaagaaaagaattgatctcttgatttcttaaataaaccaataattttaaacactttataattacttctccttaaacctttaacctccatcccctcctcagagaacaagaaaaagaaactttaaaataggaagcaatccaacaaatatagctataaattttaagaaaagaatagcaatcttctttctaaaactttttttttctcatattcatacactgtaggggaaaaaaatctacctttacttgctaaataaatgcattttaatatctagcttcctaagaaatagctatagctttggaatatgttacataactctgtaacattactatagataattacactttgctagcagcacaagaagaaactgtaattctgttatttcattgctataaatgcatgagaaagaaaatggtgtattagaaagtatacgttgcattttatttcttacttctttttactcaatattatgtattatgatttgtacacattgttgtatgccaatcaattcttttgcttctaactgctgcattatgctccagaaattgcattcactacatttctgatccagtttgcttgcactgaacctctaggctgcctttatctccctgctaccacaaacaatacggcaggaaataggattaattttgctaagtactgtaagatttctttccagaacgactgcatggtctacactttgactagcagtgcaaaaaaattatatctttccacatctttctcatcacttgatattaaccattttccttaatttttgctgctgttattaaagtaagtgctgtcttattgatattttagtttgcctctcttgcattgagttgagtttctcttccagtgagttggaatttctctttatatacttgaaagccattcatagttccctttctgtgaattgcctagtcatgctgtttgcccattttgctatttagcttcctgccttatacacttgtgatataaattaaagttacatatgcatacaaattacataacatgttttacacagataaccgagtatttaattactcccctagtatacacaacacctgcctgcaaatagcctcgctaatgtactatttttaattctaatttaagctaacaattatagggcgttatttattagaaattttattctagaatatttacatttcctgagaatttatactacttgaaaagttcaattgaaataaaaatctacatgcagaatgattggaaatctccaaatcttccacagtaacagaatgataaagtaaattcgactggagaaatatggtagaatatactgttgcaaaaaaattatagttataaaggttgtataataattcattccagaaacattcattggggtcttatagaatactaagtaccacattcagttcaggaactacacacgttatatttcaggctacatacaaacagcacatcatctagttcacaaaagtacatgcagacagtgattatgggttatctgtgtactgtgcagatatgcttacatggaatgggctgtgggggttcagaggacaggaaccctctgcccagagtcaagaaagtgaagtgctttgaagaggagtctaatgtgaagctgagttgtaagaaataaacaccgagtgctccagtggagtacggaggcagccttcagttgaagaataggaaagcatatgcaaaggcactggggtgtgaaagagcatagcctgtttcaggaattcctgattgatttttatggttaaagtcctggagagatgtccaagacctgctggaatgaaactggagactaggaagataggaggaggcatgtgatgaagattcttctatgcctttcccgagaggtccccagatgttgaatataaacctatcaaaggcacatatgcacagttataaggcactgggctgggagttgaggatgtggtagtggataagactgacaagcctctgttgcagggtctgaagtgaagaactgacatcctattttatgttttcaatcgttagtctggatgaagtgtagaataaaaagtaggaattgaaccagggaggctagttacgttgctttggcaataatccagacccgaactaaagcaaaaatcatttatggcatattcatgggaagtaaaaaatatggaataaaaatttgcaataattagcataatcttattttgaagatgacttcatagtattaaaacttttaaatgcaaagtctaattaactcttgcagtagactctgagaatgatgttatcatcacctccacattctagatggagcctcagtgagcgtcacatccaaggaagacaaccaggaaatggcagaacagaactgctgtctccattcactagatactaattcatttattcaccaaacatctaatgaataacttgtatgtgccaggcacttttctataagctggggtaaaaatcctaacaaaataaaaccctcttcctcgcaagagtttgctgtgtagaggagaccaataagtgaatagccagttagaatgcacttcaaagggcagtctgatagggtgtgtgagtccgaccggcctgttcattcagagtcctgtaaagtataaggaagtgtaacgtcaaactgggaaggaaaatctgttgcccgagggtggcaggaatgaaatgtatgtgtttcctcctaattcattgaatgttatcatggcagttttacaatttaaaaggctaaaggaagataaacaagagagaataagcatccaacacagaacaaccatgacttcatggcagctattttatctctttctattaacagagtgcatagaaacaatatatgtgccaaattcataagcaagtgcttgaaacatgagatagctatagagaatttccttaatttaaagagctaagtgtttaataatcaatgccagcaaatagactgaagaggtaaaggatagtaaaatagaactaaggaaactggatcagataacattgtttgcactaaatgataaacatgtcaaagtggacgtaattagcaatgaagcctgcagttttgccagcagcattataattcaaatcattcgtccatttctttgtcaaaatatgtttgagaatttgttttgtgatatatgagaacatcatgtaagaagtatcaattctagactgagtgttttttaaaaaccacaaatgcattttttaatgcatgagggcatattacccacaaaaagtgctcaagtaaattaagaagggtgtttggctattaaagatcgatataaaggtgtaaggtttgtggaactaagattaacaggttggaaggattgcctctggtgatcaaaccactcgttttatcattaatttcaccatataggttttgttataggcagtatcgtacatattgatcataatgttcatcagatgtaactctgcgggataatgattatctttctctttgatgaggctgtagtggatactggaaagaggatgggatttgaagctggaaagtctaagttttggtttcacttcttgtcagttgtgtgtccttgggcaagccttttaatagctctgaaatctgaattcctcaggcaatttcacaaaaagtttttgtgatgtttaagtgagataacatgtgccggcatttgcaaaacaataaaatgccacataaatatcagttatttattactctacatataattttaaaggaaattattaagctttaatcaaaaccaaaacagagctaagttacaaaaaagaaagaaactctgaccagaagcagactttatctgctttcattaccttgtcacctcataatattcatttcaaaacatttttttggaagatggagggtcataattgatgggctccaacagaacacagtccagaactttggaggaaaaggaaaagattaacatctttcaaatactatagagaaaatgtagtaaagaatatgttctttgagaatctcaatactcaaaatccctacctaattaaccattcctctttctcttattggtttgggttagtaatcatctcttctttttaagggaaaagaaacaaaggttaaatgactgatacaaagctcaagctagtagcagtccttagatcctcagactctgaaatccggcctgtattagctaagtcaccaataaacctttcaagttgccattgacttaaataaaaccttcacatcaacccatttgtgtcattgttgctttatctgctgtacccacttgaaatattaccctcttttctaatggatagagctgtgacctcaaacaggcacatattccttctgctaccacttctaaaccttgagaggcacaaaccacatctaaaaagcctcaatgagaaagttcctgtgaagaaaaatgacagagtgcttggaagcattaaatagaaaaaaaaattcagtagaagtttcttatgattgtatagagtcataattggcaagttggagttttggcagaggtagcactaactgcttttctgagttcttctatgccaagactgttttagggaaaagttcattttctctacatcagtagcaccattgtagtctcaaagagagtaaaaacagcaataataacaatagtacctgacaattacatggcatttactttgtgtcaaacactgtcctatgcgctttttatattaagtcattgtccctacatatcatcaacaatatctccagggtacaaaaaagctgatattttatccaactgttagcctttaggtaaacaataatttaggaaactgaagcagtttataatgaccagtttcccaacagagatatacacacatcccatcttcttagcaaaacctctatgaagaaagcaagtaaaacaattttaatcccctgtacttgtagttcagtacatttgctagtaagaggcagaaagatattctgagaagcaaaagatttgttaaatagtctaagagagggattgtcttccaggtaacataaaaatgaacttttttgtataacttttctctggctaaattgagagaagtcaataaaatcctacttacccctgatgcagaaggccttctgtagcagacagatttttacaaagtgttagcagaataattcacattgaaaaaacatctgttttccaaaaattgcacttatttgtgccatcgaaaataggaagagaaataactgaagccagtagaaatacaggcacaacagctcgatgcttcacagatggcatttgagcaattgcagacataaacaaagctctctgcaaagagtatatgggattgggttcaaggaagtgatcagtaggatgtgggtctgtgagatgtgtgggccagtacaaatcatggaattgaagaccgaaaaccatgatgatgtgatgatgaccaggggagaccttgagtgaccacatgctccactgatattttagtgggtgagcaggtagtaaacactatactgtttgctcttttgttctgttttgtttttaacctaaaacctgaatttggctgtttaggaaactacataggatgaattcagctcattttaaccagtcttttttcaaatttatataatcttctatcatgtgttgcctttatgtattgtaagaaaggagtttcccagcctgttgtgaccaaccaaaattgtgaacactatgtttggagtcccatatggagcagggcaggcagcaacctttttgacaaaatgctttctttgaattatcacactcttcttgtttgtatccagagcagagcatgaaaaaagagtgtaaggaattacttccactaagcccataacccttcactcagaagcagaaatgactgcacaaaagcaaatgtgtactaggcagcttaattctgatgtaatttaacttttacagtacttttaaactaaatctgaaataacacccaacctcagtagtattaacattcaatactgttggctgggcatggtggctcacgcctgtaatcccagcactttgggaggctgaggcatgtggatcacaaggtcaggagttcaagaccagcctggccaacatggtgaaactctgtctctactaaagatacaaaaattagccgggtgtggtggtgagcacctgtaatctcagctacttgggaggctgaggcagaaaattgcttgaacccaggaggtggaggttgcagtgaaccgagattgcaccactgcactctagcctgggcgatagagcaagactccgtctcaaaaaaaataaataaataaaatcaaaactgttttattccgaaacagtgttgattctagaaagaatgagataaaggcataggttgtctttgcactggtcaaatactaccgataggaaagtaaacattattcccaaaaaaagcaattattagcagggcacagtggcatgcacttgtaggcccagctgctcagaaagctgtgacaggaggatagcttgaaaccaagagttcaaacctagtctgggcaatgtatccagaccccttctctaaaataagtaaataaataaaaatacaaagtttccaacacatgagtttaagagaagaaaataaaacagatatctatttattgaaaaagtaattatgatgctctttataactattaaaggctgtatcagaacacacggccccagttatttaattccattaactatctactttatattgctaaatgcaagcaaagcacattattgttgctggataaaataagatgaaatgttaagctctttagagaattacaaagcagtgatgccagattttcatacttataactcaatatgactattcccatagaataaatatctggcttaacttgtgtaatcatttaaaaggtcccaaagtctccttcctggctctcttctcacctctcaaatgttaaaaacacatttcctgacacagctatggtgcatgccagctccctgtcaatgtagagtaagaatgagaactttgacacagaggccatcaacaactctccatggaccgccactgtttggagtctgtttctctctttggagatgaggcatcttcttggtccagcgcctctactcttcgttctacatcattttccagctacggtctctttgtaggaattctcaagattccaaataagccctactcttggccaaacttggttttggaacacaaaatcatttcttaagatgatcaggcaccaaaataatcaaaccgttaattttctagcattcctgtaattctgcagtgactggaaacttaaaagaaaatacacaccccaggaattaattccacaaataaatgttaagcttagaggaggtttaggaataaaatgataaataatagaaaataataaaaaatataaaactaatgtcagagatgagtagaattagacaattctgatttgccattttattcaataaactcaatgtttatttatttacaataatgagcatataggtattcaataaccacttcatgttagcctttatagtagtgaatgggcatctatgtatctataaatagctgtgaaaatgaaagcagaaaaatggaaaaatatatagcattttatatatatagtattaattcaaaaaatatttagaccataatagtaaatattcctgggagatattccttggaaaaagaatacgtcaaaagataattccatggagaagactcagacttcttattcactgcttatctattatgtgcagaatacagaactgaaacatacaagcacaattgtatcctcaaagaaggcaagttccatgggtaatattgatatgtaaacagctcattgcaatgaagccaaaccataatgaagatgttatatttattatcataaatatttaaaatacgttaaaacatacctatctcttttatatactatattaccataaatgttataatatattaataaatattgtactttatgttataatctataataaacatgttattttgtgattgtataacaaggtatattgccataataaaatagaaattttattgagggctagaggctcttgtaataaaaccatacttacggaaagatagtcaaggtaactggagcaattttttaaaatctattcttagtttagcataagattttaatagattagatatgtgaaaatgaaatattctcctttctcttctaaatcttctcgcttttccattgtatataaagccactgagaaatcagattattgaaagaatattttgccatgttagagtcatagcatcttatttttaagtccgtcagaaggatagccatcagttattataaattctttttctcaggacgaccaaagaaacacctgttgaattatttttctgtttctttcctcatgttttacataacattgttccaaaaaataattaaagaaagcttacaaaaatatatatcctccaacgtgcattggtactcagaagtaaagctgaagttaaaagtctgtggcattctaacagccaaggactcttctgatattcataaaaagacatagcatgtcccaatcatacacaacctctaaatgtgttactctatcttagttttttaaatatcttttgaaagccctaatagaatgaggcaggagaatagggtctggcggcagggaacctaaggactttctagaactaaatcaaacagaaaaactccaactttctacaacgacgtaaataactttgtgacttcatttcagctatggcaggaaacatcatcttcatttgcatagagtgtacaccaagtaaccgatgggaaacctccagagggtatttaaaccccagacaattctgtaaccagaccttgagccacttgcttgagccctttcccactctgtggagtgtgtttttgttttcaataaatctctgcttttgttgcttcattatttccttgctttgtttgtgcgctttgtccagtactttgttcaaagcgccaagaacttggacaccttccaccggtaacaagaatagcatctcactctataaataagaattagggcttggacttggccagaagtggaaagcagaatatctattattactataggtaataatgacaggtggcagttattaagtcaattcagtttacatgtaatataagtcccatgtattacatcaattggttctcaagaagtctcttaccagatagaataaaactaataatttgtttatctaatgaacaatattctacaaggagtgcttgaaactttacatctattatataccatgtagtcgccaataacatatacaggttggtaaaatatctttattaaaaatataaaccttggaggtttggagaacactgctgactattttcaaagattctcatcattttcccaaaacaaaaagatctagaaagataagaattcatccacacaagacccatgacttcagcattagatagacaacactccaagttctaattatctgtaagctgaagaaagaaaaaaacatcccaacagagtttccaccactggcctacccctgcaaccagcctgtggatacagacagcaatggagaggaaactgaaaagactccatcaaaaagcagaggatatacctagaagaaacaagcaaaacatccacagaaaaaaaaaagtgaaacaataaatgcaaaactgatgtaaacaggtctggatttggtagttcataggcctggctatggggaaggaggtgggaagtgtagggtaccagaagtgatgaaatggttatgtagtaacatttctgaaattatttaggtgggggattcgatgtggggggatgaagggttagggcttgtttaactaaatttcatagtgtgtgtcttaagggtcctccaaaggcagatgcatttttcaactctggagctaattacaaagagcaggacattctgaagccttcctctttccagtcaccacagcactagatgaccagaggacatgatactctggttagaatgttcacccacagtaccaaacacacagcaaagtcaatgctggagtattaaatgactcataatattccgcagtgcttactgagaaaaaaaaattccatagtaatggtactaacaaatatgtagacgtcctagaggcattacagtagtaaagacaaagaatttttctgcaaatagaaagaaggccgctgaaacaaagaaacaattaggcacgcaagaacatgagataagaaaagttgggacacacagaaaaatatcagagatacctgtgactgttcagaatgtacaattctcttatccatactctctcttacccatatccattttagccagttcctgaataaaatgatttaagatcttcagtatttcctctgtgagttgttgtataataatatttaggttaactgaatagaaatctgtattatttctggctgcattctcatcaattatgcatatcccttcataaagtcctgaattaaagactatttccagctatttacattcaaatgtctctggtgtgtaaatttacctaattactataatcattagggtccaaagtcaggcaagccagtttagttataacctttagaaaatgtgccttagccacatttatttctattcccatgtgctagatgtaacacctttacttgttaagaacttcaaccaaaatggagagaagctagttttgcagaaaaacaggtaattgtgtgaacaaattcatttccatgtgtttgttgtggatccaattacagacacctactttaagttggtaagataaagatactcctttgctttcatccagtgaagtttcatgcaagggactgaaaaaagggtttatttccaggagactgtttttgccattgaaaactctgtcctcttcagacatttggcaaatgatacattagcagcggccacaaggatcacattgtttcacaccgaatagctcctacactttgattcatatatcacacttgttctgtttcttgcatttctgtttcacacccactgcctaagtgcaaagggatttgaagacaagcaacacagttttctaactttcagctgcttggttgtattgatggaggaagttatggaacatgcagaaaatagaatcaagattaaggagatcatatttctgttttatgccctgtgatacagtgaaggtcactgagtaacaattactcagaacattcatttcggatcctttagtttcactgaaaatcccataaattggcaaaaacaataaaagaaaagattattctagagaagagagagccagaggtgtgacttcatagaatgtaaaggaggctataaataacaataaattgttgttttataaaataaattgacaagcagttctccgtaccttttgagaaatttaaaacaaggaagtgaaatgaaatgactccaggaatgtttgtttcttacagataacaacaaataacaataatactgagatataataatgaggatgattaccgtaatttccttatgatgttttaaaatgcacaaatagtctattaatgagtcttgaaattttgagtagttatacttctggtgattccaggagacttaaaaaatgaattcaacaaatagccttaggaaatcctatctgatcctattaattcacacttttcaaataaatttaaataagttattgatctaccagatgagtagctaatagatgttcaactcccaagacattattcttgaaataatataattaattttacaattaatgggaccgtgtgaccatacatctaactaaaccctttttttggtatatataaaggtgttatagaggagacaagtgagtctggaagataggacagacttgttcagtaccacatagtgaattctgtagctcaggaatcctgatttccaagtcaacgtttttgccactgtatctcatttcacacacaatctgcaatgacaaatctatatggatgtactgctattcctcaggtccaccttctatgcagcctagttaacttccagagggactggaaagagatttaaacatcagttcttccaccactgcagaaagatcttttgcataatttcttaattaccatcatggagaatgtagagtgaaacaataagagcagtactgtcaacattaacaaaatgagaaggaggaaaattgaataggaagggtaaggggtgacttagccacaaattagatcaagtttatgaaggaagaggtgagagtgtttattgctgacaagaaagcaccatgcttcaaacatagaaggcacttaataaatatttttaataaattaagaaaatgatacagtgtggctggtaataaaggataaatatatggattcttgcccacatccttttatctatcatgattcacaattcttccttagcaagtttgccatccactgaacaccactaacaatgctactctgctgtagaaattcaatgttcatttttcctcctttgtagaaatattcatgaaatacagcttagcacaaatatctttattcattacattctgactaatattttttaactctatgaaagctcagagaagcttttgaagtactatctactagaccctaaaacagactgtctaaaatattcttttgaaaacgtaactacagcaaggtaaaaaaatccatatatattcattgtatgtatgtgtatatatatatatgtttatgtatatatgtgtgtgttaatatgcatttatacccacacatacacacacacacacacacacacaacacaaaaatttggccaagctgctgtgatgaagaaaatactaaatataatgttacttagtacacaatgacttttaatgacacatcgccgttccacatggttctaaacatatatttctagaaacaaaaagctaacaaataaacaaaaaagttctaattctttccaaacaagatcttattaaaatggaaatttggtcttcaaaactcattggcagcatataccaggagtactgatggcaaaaacacattgcctttgaagaaatataaattctacatagaaacacttcaatgtctttaaaaaacaaatttaaaaccccactgttatgattcatgaaatccttattttttacacattagagctatagatacccatggtgtcctcaacaagtaatcactgtccattaaagcacttgaaaaagcaggaagacagtcacgctaaaaaataagaaccctgactatgatgaatatcatagtcatatatcaatatcatatatatggaattttttaaccttacagcagttatgttttcaaaagaatattttggacagcctgagaggcccagcagggctatatctagaagtcaacttcaacaggatggacctgcccaggataagctgattcaaatgagctatgttgttgcatctttcttcggttctttgtaatatgattttccatttttaattgatacttaataattgtacatatatacatacaatatgtaataatcaaatcagggtatttatgatatccataatctcaaacatgtatcatttctatgtgttgggactatttcaaatcttctcttcaagccactttgaaataaacatgaaattattattcactatagtcaccctattgtgctatacagtatcagaacttattccttccaactagttgtatgtttgcacccagcttctcttcactccccacatccactcttcccatcttctggtaaccatcatcctactcttcacttccatgagatcaactatttttacttccatagattagtgaaaatatgtgatatttgtgtttctgtgcctggcttatttcacctaacataatgtcctccagctttatccatggtgctgcaaataacagagtttccttctttcctatggccaaatagcattccactgtgtaactatacaacattttctttatccattcatccattgatggacactaagattaattccatatcttggctattgtgaacaatgctgccataaacctgaggctgcatgcatccctttatatactgatttcctttcctttagataaatacccaatagtgggattgctggattatatggtagttctatttttagtttttttttctaatatctttttttttattatactttaagttttagggtacatgtgcacaatgtgtaggttagttacatatatatacatgtgccatgctggtgcgctgcacccactaacccatcatctagcattgggtatctctcccaatgctatccctccaccctcccccaaccccacaacagtccccagagtgtgatgttccccttcctgtgtccatgtgttctcattgttcaattcccatctatgactgagaatatgcggtgtttggtttcttgttcttgcaatagtttactgagaatgatgatttccaatttcatccatgtccctacaaaggacatgaagtcatccttttttatggctgcatagtattccacggtgtatatgtgccacattttcttaatccagtctatcattgttggacatttgcgttggttccaagtttttgctactgtgaatagtgccgcaataaacatacgtgtgcatgtgtctttatagcagcatgatttatagtcctttgggtatatacccactaatgggatggctgggtcaaatggtatttctagctctagatccctgaggaatcaccacactgacttccacaatggttgaactagtttacggtcccaccaacagtgtaaaactgttcctatttctccacgtcctctccagcacctgttgtttcctgactttttaatgattgccattctaactggtgtgagatggtatctcattgtggttttgatttgcatttctctgatggccagtgatgatgagcgttttttcatgtgttttttggctgcataaatgtcttcttttgagaagtgtctgttcatgtccttcgcccactttttgatggtgttgtttgtttttttcttgtaaatttgtttgagttcattgtagattctggatattagccctttctcagatgagtaggttgcgaaaattttctcccattttgtaggttgtctgttcactctgatggtagtttcttttgctgtgcagaagctctttagtttaattagatcccatttgtcaattctggcttttgttgccattgcttttggtgttttagacatgaagcccgtgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagcatagtttgaagacaggtagtgtgatgcctccagctttgttcttttggcttaggattgacttcgcgatgcggactcttttttggttccatatgagctttaaagtagttttttccaattctgtgaagaaagtcattggtagcttgatggggatggcattgaatctataaattaccttgggcagtatggccattttcatgatactgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcaagatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctctcttgtgccagtgttcaaagggaacgcttccagtttttgcccattcagtatgatattggctgtgggtttgtcatagatagctcttattattttgaaatacatcccatcaatacctaatttattgagagtttttagcatgaagagttgttgaattttttcaaaggccttttctgcatctattgagataatcatgtggtttttgtctttggttctgtttatatgctggaatacatttattgatttgcatatattgaaccagccttgcatcccagggatgaagctcacttgatcatggtggataagctttttgatgtgctgctggattctgcttgccggtcttatattgaggatttttgcatcaatgttcatcaaggatattggtctaaaattctctttcttggttgtgtctctgcctggcttttgtatcaggatgatgctggcctcataaaatgagttagggaggattccctctttttttattgattgggatagtttcagaaggaatggtaccagttcctccttgtaactctgatagaattcggctgtgaatccatctggtcctggactcttttttgttggtaagctattgattattgccacaatttcagagcctgttattggtctattcagagattcaacttcttcctggtttagtcttgggagagtgtatgtgtcgaggaatttatccatttcttctagattttctagtttatttgcatagaggtgtttgtagtattctctgatggtagttcgtatttctgtgggatcagtgatgatatcccctttatcattttttttgcgtctatttgattcttctgtctttttttctttattagtcttgctagtggtctatcaattttgttgatcctttcaaaaaaccagctcctggattcattaattttttgaagggttttttgtgtctctatttccttcagttctgctctgattttcgttatttcttgccttctgctagcttttgaatgtgtctgctcttgcttttctagttcttttaattgtgatgttagggtgtcaattttggatctttcctgctttctcttgtgggtatttagaaagggtatcagtgatcgaagatgaaatgaatgaaatgaagcaagaagggaagtttagagaaaaaagaagaaaaagaaacgagcaaagcctccaagaaatgtgggactatgtgaaaagaccaaatctacgtctgatcggtgtacctgaatgtgatggagagaatggaaccaagttggaaaacactctgcaggatattatccaggagaacttccccaatctagcaagacaggcaaacattcagattcaggaaatacagagaacgccacaaaggtgctcctcgagaagagcaactccaagacacataattgtcagattcaccaaagttgaaatgaaggaaaaaatgttaagggtagccagagagaaaggtcaggttaccctcaaagggaagcccctcagactaacagtagatctctcagcagaaactctacaagacagaagagagtgggggccaatattcaacattcttaaagaaaagaattttcaacccagaatttcatatccagccaaactaagcttcatacgtgaaggagaaataaaatcctttacagacaagcaaatgctgagagattttgtcaccaccagacctgtcctaaaagagctcctgaaggaagcactaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacataacaatattaactttaaatgtaaatgcactaaatgctccaattaaaagacacagactggcaaattggataaagagtcaagacccatcagtgtgccgtattcaggaaacccatctcacgtgcagagacacacataggctcaaaataaaaggatggaggaagatctaccaagcaaatggaaaacaaaaaaaaggcaggggttgcaatcctagtctctgataaaagagactttaaaccaacaaagatcaaaagagacaaagaaggccattacataatggtaaagggatcaattcaacaagaagagctaactatcctaaatatatatgcacccaacacaggagcacccagattcataaagcaagtcctgggtgaactgcaaagagacttagactcccacatattaataatgggagactttaacaccccactgtcaacattagacagataaacgagacagaaagtcaacaaggatacccagaaattgaactcagctctgcaccaagcggacctaatagacatctacagaactctctaccccaaatcaacagaatatacattttttcagcaccacaccacatctattccaaaattgactacatagttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacaaaatgaaggcagaaataaagatgtcctttgaaaccaacgaaaacgacacaacataccagaatctctgggacgcattaaaagcagtgtgtagagggaaatttatagcaatatttttagtttttaaagaaatttctagaacagctccggtctacagctcccaaggtgagcgacgcagaagacgggtgatttctgcatttccatctgaggtaccgggttcatctcactagggagtgccagacagtgtgcacaggtcagtgggtgcacgcaccgtgcgcgagccgaagcagggcgaggcattgcctcactcgcgaagcataaggggtcagggggttccctttccgagtcaaagaaaggggtgacggactcacctggaaaatcgggtcactcccacctgaatattgcgcttttcggaccggcttaaaaaatggcgcaccacgagattataccccgcacctggctcagagggtcctatgcccacggagtctcgctgattgctagcacagcagtttgagatcaaactgcaaggcggcagcgaggcttggggaggggcgcccgccattgcccgggcttgcttaggtaaacaaagcagcctggaagctctaactgggtggagcccaccacagctcaagtaggcctgcctgcctctgtaggctccacctctgggggcagggcacagacaaacaaaaagacagcagtaacctctgcagacttaaatgtccctgtctgacagtttgaagagagcagttgttctcccagcatgcagctggagatctgagaaccggcagactgcctcctcaagtgggtccctgacccctgacccctgagcagcctaactgggaggcaccctccagcaggggcacactgacacctcacacggcagggtattccaacagacctgcagctgaggttcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaagggaacaaagctggatggagaatgactttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaagctcaagaactacgtgaggaatgcagaagcctcaggagccgatgcgatcaactggaagaaagggtatcagcaatggaagatgaaatgaatgaaatgaagcgagaagggaagtttagagaaaaaagcataagaagaaatgagcaaagcctccaagaagtatgggattatgtgaaaagaccaaatctacatctcattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaacgttaagggcagccagagagaaaggtcaggttaccctcaaagggaagcccctcagactaacagcgaatctcttggcagaaaccctacaagacagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccatcgagactaggaagaaactgcatcaactaacaagcaaaataaccagctaacatcataatgacaggatcaaattcacacataacaatattaactttaaatgtaaatgcactaaatgctccaattaaaagacacagactggcaaattggataaagagtcaagacccatcagtgtgccgtattcaggaaacccatctcacgtgcagagacacacataggctcaaaataaaaggatggaggaagatctaccaagcaaatggaaaacaaaaaaaggcaggggttgcaatcctagtctctgataaaagagactttaaaccaacaaagatcaaaagagacaaagaaggccattacataatggtaaagggatcaattcaacaagaagagctaactatcctaaatatatatgcacccaacacaggagcacccagaatcataaagcaagtcctgggtgaactgcaaagagacttagattcccacatattaataatgggagactttaacaccccactgtcaacattagacagataaacgagacagaaagtcaacaaggatacccaggaattgaactcagctctgcaccaagtggacctaatagacatctacagaactctccaccccaaatcaacagaatatacatttttttcagcaccacaccacacctattccaaaattgaccacatacatggaagtaaagctctcctcagcaaatgtaaaagaacagagattataacaaactatctctcagaccacagtgcaatcaaactagaactcaggattcagaagctcactcaaaaccgctcaactacatggaaactgaacaacctgctcctgaatgactactggatacataacgaaatgaaggcagaaataaagatgttctttgaaaccaacgagaacaaagacacaatgtaccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaagcaagaaataactaaaatcagagcagaactgaaggaaatagagacacaaaaaacccttcaaaaaattaatgaacccaggagctggttttttgaaaggatcaacaagattgatagactgctagcaagactaataaagaaaaaaagagagaagaatcaaatagacgcaataaaaaatgataaaggggatatcaccaccgatccctcagaaatacgaactaacatcagagaatactacaaacacctctacgcaaataaactagaaaatctagaagaaatggataaattcctcgacatatacactctcccaagactaaaccaggaagaagttgaatctctgaatagaccaataacaggagctgaaattgtggcaataattaatagtttaccaaccaaaaagagtccaggaccagatggattcacagccgaattctaccagaggtacaaggaggaactggtaccattccttctgaaactattccaatcaatagaaaaagagggaatcctctgtaactcattttatgaggccagcatcattctgataccaaagccgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccatcatataaacagagccaaagacaaaaaccacatgattatctcaatagatgcagaaaaagcctttgacaaaattcaacaaccgttcatgctaaaaactctcaataaattaggtactgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggggaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccatttacaattgcttcaaagagaataaaatacctaggaatccaacttacaagggatgtgaaggacctcttcgaggagaactacaaaccactcctcaaggaaataaaagaggatacaaacaaatggaagaacattccatgctcatgggtaggaagaatcaaaatcgtgataatggccatactgcccaaggcaatttacagattgaatgccatccccatcaagctaccaatgactttcttcacagaattggaaaaaactactttaaagttcatatggaaccaaaaaagagcccacaccgccaaggcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatgtttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtccaaaacaccaaaagcaatggcagcaaaagccagaattgacaaatgggatctaattaaactaaagagcttctgcacagcaaaagaaactaccatcagagtgaacagacaacctacaaaatgggagaaaattttcgcaacctactcatctgagaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaacgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtggaaccgtaaactagttcaaccattgtggaagtcagtgtggcgattcctcagggatctagaactagaaataccatttgacccagccatcccattactgggtatatacccaaaggactataaatcgtgctgctataaagacacatgcacacatatgtttattgcggcattattcacaatagcaaagacttggaaccaacccaaatgtccaacaatgatagactggattaagaaaatgtgacacatatacaccgtggaatactatgcagccataaaaaatgatgggttcatgtcctttgtagggacatggatgaaattggaagtcatcattctgagtaaactatcacaagaacaaaaaaccaaacaccgcatattctcactcataggtgggaattgaacaatgagatcacatggacacaggaaggggaatatcacactctggggactgtggtggggtggggggaggggggaggggggagggatagcattgggagatatacctaatgctagatgatgagttagtgggtgcagcgcaccagcatggcacatgtatacatatgtaactaacatgcacaatgtgcacatgtaccctaaaacttaaagcataataaaaaaaatttaaaaaaaaagaaatttctatattgttttccataattactgtagtaatctacattaccatgaagaatgtatgagagttcccttttctctacatccttgccagaatctttttttgtttttttgtttttataatagccattctaacagggataagataatatttcattgtaaatttgatttgcatttccttggtgattagtaatattgagcatttttcatatacctgttggccccatgtatattgttttttcagaaacatctatttagatcctttgcccattttttaatgggattgtgttttttatttgtttgttttgttttttgttgagttgtttgagttttttgtattttctagatattaatcccttatcaaatgactaaaaataccatctcccattcaagaggttgtctcttcactccattgattatttcctttgctgtgtagaagcttgttagtttaacataattccatttgtctattttttgtttttcttgcctgtgcttccagagtgttagccacaaagtgttctcctagaccaatgtcttggagtattttctctatttattcctctagtagtataacagttttaactcttatatttaagtgtttcatccaatttaagttgatttgtgtacatggtgagagatagaggtccagctcattattctgcatagggacatacaattttctcagcacatcatttattaagaaaggtgtccttccccagtgtatgttcttgacacctttgtcaaaaatcagttggttgtaaatatatgggtttatttctgggtctctattctcttccattggcctatgggtctgttttttgttttgttttattttagagacagtttctcactgtcacccaggctggagtacagtggtgcaatctttgctcacagcaacctcactctcccagactcaagcgatcctcctgcctaagctccccaaccagtagctagcactacagctgtgtgctactatgcctggctaatttttacttttttttttttttttttttttttttggagagactgggatttgctatattgtccaggctggtctcaagctcctgggcccatgatctgaccacctcacctcccagactgctgggattacaggtgtgaaccaccatgcacagcctatgtgtttgtttttatacaaacagcaagaagttttatttactctaggattgcaatgtattttaaagtcagatattttgtgcatccagctttgttctttttttttttttttttttttttttttttttttttttttgagatggagcctccctctgccgccaggctggagtgcagtgggcaatctcggctcactgcaacctctgcctcctgggttcaagcaattctcctgctcagcttccaaagtagcaggggctacaggcacgcgccaccacacccagctaatttttgcatttttaggagagatgggatttcaccatgtttgctgggatggtcttgatctcttgaccttgtgatccgcccgcctcggcctcccaaagtgctgggattagaggcgtgagccaccgtgccagcctttgttcttgttctttaggattgctttggccatttaggctcttctttggttccatacacattttaggatttttttttctatttttgtgacaaatgctattgaaattttaataaagcttgcaatgaatctgtagattgctttgggtattatgatcattttgacaatattagtttttccaatccaagagcataggatgtcttttcatttgtttgtgttctctccaatttctttcatcagtgttttgtaatttttcttctggaagtcttctacttccttaattaaatttatccctagagtttttttgtttttttttttgtagcatttgtaaatggagttttttttttatttcctttccagctagttcattattggtgtgtagtaacactactgacgttgtgatgatattgcgtcctgcaactttactgaatttgtgagatttcagagattttagtggagtctaggtttttctaaatgtaaagttatgtcaggtaggcgtggtggttcctgcctgtaatcccaacactgtgggagtctgaggcaggaagattacttaaacccagaatttcgataccagcctgagcaacatagtgaggctttgtttctatttaaagtaaaaaaaaaattagccaggactggtggcacatgcctgtggtcccaactacttgggagggtaaggcagggggattgctttagcccaggaggttgaagtttcagtgagctatgattatgccactgcacttcagcctaggcaacagagcaagatcctgcctcaaaaataaaaaagggacaacttgacttcctcctttccaatttgagtatctttcatttctttttcttgcctgattactgtggctaagagttccagtacaatgttgaataggagtggtgaaagtgggcatctttgtctagttccacttcttacagaaaggttttcagattttcccttcattatgatgttagcagtgggtttgctatagatggcctttaccatgttgaagtatatttcttttatgcctagaatgttgagcatttttatcaggaaggggtgttaaattttatcaaatgctttttctgtatctgttgcaatgatcatatggtttttgatttttgtccttcattctgttgatatgatgtatcacatttattaacttacatatgtcgaaccatctttgtatccctgagataaatcccacttgcttatggtgttttattttatttttggatttgctgttgaatttggcttgccagtatttgtttaggatttttgcatctatgttcctcatggatactggcctgcggttttctattttgttgtgaccttgtctggttttggcatcaaagtaaggctgtgtctgggttcagtggctcacatccgtaagccaagcacttagtgaggctgacacaggcagactgcttgagcctaggagttcgagaccagtttgggcaacatagtgagatgcccatctatactttaaaaacaattgtaaaaattagctaggaatggtggcacacaccagtagtcccagctactcaagaagcagaggtgtgagaatcacttgatcccaggaggtcaaggctgcagtaagccatgatcgtgccaccacactctagcctaggcaacagaatgagaccgtgtctcaaaaacaagctaagtaacttaaaatcaaagtaatgctggccctgtagagtgacttaggaagaattgtatcctccttcattttttggaataggttgagaaaagttggtgctagttctttataaatttgatagaattcagcagtaaagctgttcagtcttaagtttttctttgataggagactttttattgccaattcactcttgctacttgttattggtctgttcaggttttctatttcttcctcgttcaatcttaataggttacatgtgtccagaaatttattaattttctttagtttttctaatttgttactgtataggtgttcataatagtctctaatgatcctttttcatttctggttttatatatttcagtcttctcccttttgtgagaggggtagtctaggtagcagtttatcacttttgtttgtctcttcaaaaaaccaagtttccgtttcattgtgttttgttcacgttttcttttttcttgtctctattttggttagttctgctctgatctttattatttcatccctcctactagttttgagttttgtttgttctggcttttctagttccttgaggtgcatcattaggttgtttatttgaaatctttctacttttttgatgtagatgtttgttactataaaccttcctcttggcactgcttttgctgtattgcacaggttttgttacattgtgtttccattttcatttacttcttgaaatttttaatgcttcctcaattattttattgacccattggtcattcaggaccatgttgtttaatttttatgtatttgtacagttttcaaagttctacttgttactgatttctagttttattccattgtggtctgggaaggtacttgatattattttaatttttaaaactttgttgagacttcttttgtggcctaacacatggtctatcctggagaattttccatgtgttaatgagaagaatgtgtattctgcaactgttgcataagatgttctgtaactgtctgttaggtccatttggcctaaagtgcagtttaaatccaatgtttctttgttgattttctgtctagatgttctttccaatgccatagtggggttttgaagtcccaaattattattgatttagattctacctgttcctttagatctaagaatatctgctttatatatctgggtgcttcagtgttgcatgtatatatatttaaactggttataccctcttgttggattgattcctttttcattatataatgaccttctttatctgtttttatagtgtttgacttaaaatctgttttatctgatgtaagtacacctatttctgttcacttttgacttccatttgaggggaaaatctttttccatcccttcactttcactctatgtgtgtcttcactgatgaactgagtttcttgaagacagcatatcattgggtcatgtttgtttatctgttgtcagtctacatcttttaagcagagaatttaatccatttgcattcaaggtttttactgataggtgagaacttactccagtcattttggtaattgctttttgattgtttctctatcatttgttccattctttttctctcgttctttatcattatagtttggtcattgtcttttttttttttttttttttttttttgatggagttttgttctgttccccaggctggagtgcagtggtgcaatctcgtctcactgcaatcttcatctcgcaggttcaaatgattctcctgcctcagcctcctgagtagctgggattacaggtgcctgccacaatgcctggttaatttttgcatatttagtagagacaagatttcaccatgttagccagctggtctcaaactcctgaacacagatgatccacccatctcagcctcccaaagtgttgggattacaggcatgagccaccatgtctggccagtttggtcattttcaacagtggtaatgttcgacttcttcctctttctcatttgtgtacctgctttaacagtgtgttttatactttcctgtgtattcatgatggtagataatgtcattttgcttccagatatggggcttctttaagcatttcttgtagcaccagtctagtggtgatgaattccattagttcttgattttctgtgaaagcctatatttctctttcatttttaaaggaatgctttgctaggtatagtattctttgctgacaaggttcttctctccccctaaacactttgaatatatcattccattctctcctggcctgtgaagtttttctcagaactctgttgttaacttgaaaagtattctcttacattttacctaactcttttgctagttttagaattgtctctttgtctttgacttctgacagtttgactataatgtgccttggagaagacctttttgcactgaatctacttggggaatctctgagcttcctgtatccaggtgtctatattttctacaagacttgggaagttttcagctattatttcaccaaatggattttcatgcctttgctcaattcttcttctggaattcccataattaaataacttatttgctttatggtgtcccatatgtgaggtaaagtttcttcagttttttaaattctttaatttttttaatctgactgggttatttcaaaagaactgtcttcaagattacaaattccttctcacatgatctagtctgttgttgaagctctcaattgtatttttaaattttatttattgaattcttaactttcaagatttctgtttggttcttttttatgatacatgtctccttattgtatttctcatttagactgtgaattactttcctgatttctttgtactgtttatctgtgtttatctgcattgtatatcactgagtttctttaatagagtaattttgaattctttttcagccatttcacagattttcttttcattggtatttattactagagaattattatattcttttggaggcctcatgcttccttacttcatatttcttgtgtccttatgttgatatccctacatatgctgtaatagtcatttcttccaattttatggattggctttcataaagaaagacttttctatagatatacatagtgttggttcagtagggtgctttggctttgattatgagtgggcacagtaatatagtctccatatgagttcttcagctgtaatcagtatcagtgtattctttgagtttttcaatggtaggctgtgggtattagtggaggctatggagaggcttttctgggaatgaggaaactaggtagggtagttcttgtgccctaggcagcatttgtgagcagcggtgatggcagggtcaggtgggtcagtccttgggctttcaggtggtttgtttgaatgccaatgatggcagtagtaagacaggtgggtgagtagattcttgggtccctgggtggtatgtggggtgccgggggtggtagtagcagcatggatcaatactcaagtcccaggatgatgtccataggagctggcagcagtggcagtgatggaaggggcagacctgttgctaggctcctggatggtacatgtagatacccaaggcagtttgtaggacaagtcaacccccaggctccctgatgacatgcacaggtgctggcagtggtgagtagtgcaggtgtgtcctcgagtctcctgatggtttgtatggacactggctgtgatggctgaggcagatcgattctccaggcttccagatggtacactcagtgctggtgccagtgggtgtggtggctctcctcagactctggaatggttccctgagagtctggtttccaggctcatggaaggcctatcctggtgcattgtggccgtgccactggagggggcatagttgctctcagtggcagtggcttggtccctcatattattaaaataaaattttgaaattgaattttaatgatgctcagaaaagcaaagcacagtcattcctttacacctcaccctgagcaagccccatccagactggcttctgcagttgccagatgcaacagatgaatatatgtttaatcaactaaccacaaaggaagaggggtcaatgttagatcttcttggatgtcttcagagggaattaacataccaacatttgtgttttcttttgtgaatgaccagcacatctaaacatacatgaagtaattgcaagcctctttaaatttatttattttaattaaagataaatttattagcttctggatcatttatattaactcatatgtatatttccatatttagatttcaccaaaaagacacataggagcaaaaaatctcactcctgtgacttgaaaaatctaaaggccattgggttagagccataatttttctttacataggggctacatataaaattagtagttgatgaagaattataaagagacacatctagtcttaaaagctacagagagaaagaatatattaatatttgcaaaccatattatccaataaaggactagtatctataatatatgcatattctcaaaactcaacagtaacaaacaaaaccaactgattagagaatgggcaaaacatacgaagagacatttcaccaaggaggatatacagacagcaaacaagtacatgaaaagatgttcaacttcactagctattagcgaattgcaaattaaagccaccacgacatatttatatacacttatataagtggctaaaataaaaaatagtggcaacaccaagtgctgacaaggatgagcaacaatggctctctaagaaacaggctggcagttgcttaaaaaccaagcatgcaagcaccgcacaaccctgcaattacactcctggcatttatcccagagaaacaaaaatgtatgttcacataaaaacttgtaaaacaatatttatagcagctttattcctgatagccccaaactgaaaacaacccagatgtccttcaataaatgaatagttaaagaaatagtggtatatccatacaatagaataaaaagcaaccaaaataatctatccaaacacacaacaatcggcatgtgtctccaaagaaatatgttgagtcaaaataactttcttgaaatgacaaaaatgaaagaaataaataacaaattagaggtttcgaggagatgggacagaagtgggtttggctacaaaaggacagcatgatagatcctgtggtgacataaattttctgtatctaaactgtatcaatgtcaatatcctggttgtgctattgtactatgatttagccagatgttaccactggggaaaccagacaaaaggtacatgtattctctctgtatcaattcttatcactgcatgtgaatctatagttatctcaaaagagaaaaataattttaaaaagtttcacacccactgtttcaattgactagccttaaaaaatagtttcagtgttaacttcctcaaaacaattagtctccacctcttctacaaccctactatccagcatttatcccaaacatattcagaaaagtgatattaattataaaacacttcatagtctattgtaattattattttaaccatctacttccacaaatctttgaggcatctatactcactagctatagttaccattgtaagcaaagatgtttatttctgtttctctcgttggattacaatctttttgtgagcaagaatagatctagtgtatttttaggtctccaagattaaatttttcttaataagctaaaaaaagagatatatctaatctgaaagataattttttcctgtggtctttccacattttatatgccaccaccatatttccttgtgcataaaatgcttttacttattggaaaaaaagggcataattctccatgaaaaaaaattagtctaatctaaaacaatgtataaatcctctatattagaggccatatgattcatagaagtcctaatgatttgccacaatacatataccagctgaatatccaacaaacaggtaacattgcctaaattctttattaaggggctcctaaactgacttttaaaaggtgtggcctcaaactgtcttacaggtagtaaaggctacaacaatctcctacaaaaagacacagcaaatattgctaaacactacctaaaaatcaaatatttgcattttatatacatactcttgtcagtggctgttcagtttgacacacataatctaactggaattcagacaactaataacatacttccagagaaaaacctgtataaatgcagaagacagtgcctgagaagccaccttaatgtaattgcttaaatttccatctttttgctttaatagcatacataaaagttttaaaaatctgacagtggaaggcattatggttcttataccgcctgtagcctaacgttgttcagttgtgcacagcagccagacgtaaagagcgaaaactgacaaagtgagaagaacagatagaatcaagaaaatataaagtcttaattctctctctctggaattccagggcctcatatggttctacatcctgacggtttttggtttgcaaaaaagaaatgcgtatcttactatatatcctctcttatagacatgcacaaaattatgatttccctgtgatttatttaggttttctcttaatttgaaaatacctggaataatgacatattacggttttatgttcgcttttaattttttctagtttttttaagtaggaaaataaatttttgctttcttactgatgtgctaaggatttagctgtagctacacagacctcatattccctcatatcagtaagtggagagaattgacgtagtagctgcacagtttactaggaatgagtgctttcttttgtccctaattttcaataggacacttttacccattcactactactcagtccctgtgaaccattagtgtgtgacctaaataaaaaggtaaaataatgttttaaaataaaataatctagacgttggcagatacagaataaacgggtggaaagattgtcaaccaaaaagcaaaggggtaacattttgtcactgataatctccgtgaagtcatattcatttttttcgcacacttctgttctatccactattattatgacatcatagttttaatttttttaggtaaagcatacacatatctccaaacatagctcagtcaccacctccctattttggatcttttaaccttattttgatatattccacctctttatcctactttctaatcttaaatatgcttctatcctttacctataactacttttccagcttttacttatctttaaaatgagaatagacaaggaaataccatggaaaaaagtgtgaaaagttatgctgatgttatggttaagcctattacaactttgaatatgtggtcatggtttcctttattttaaacatttcatacacaaagaaattctacataacttcttgggagaatctaaagaagaatatgaacccaaaaatacaacatagggcaatttattcaagactttatgctaaaacagagagttatgctcccaaacccttaaaagcaataaagagtagccacattctgatggaatagcatatctgaatgtaaaatatgaagtgaaaataaactgggaggatcaacacatgttagaaacagtataaaatgcagcttgaactaataagtgcttgaatctatttagttatgccaccttgaaatatatctacaaagtgactctggtttcctaaggtctagatgcattaaatatttaagcagatctcacactttaatcactttaaatcatgctcttttggcctaaggctactgacacttttgggcacatgcacgagacagtgaagttaggaataatacacacttaaatttttaaatcaaatttaaaattatgaaaagtaactttccaaaaattttttcctataatttctccttgttattgttgtttatctatctaaattatgagaaccttaaggcactttgtatgatttgctgccaatttaaggcccagaaacaacgccgactattagatcaatagtatagccttgaataaccaaatcttgtctaatatatatatataaaatatatcgtatatgtaacatttatatatatgtgtgtatatatattactgagagtgatccatgttgctttaagcacatcacaatctataacatgctcacctttctggtagcacatgtctggggtggaaagtcctctgtaacaggtcattttctataataatcacttatgttggtttagtcagaacactaacatttgtttcgcatgtcttttcttttaccagctgaacctcaagctgaatgtgttttttctagaaaacgctaaattgcctcagagagacttggtggttacacacagggtggttcctgccgccaaaattatgtgcgttgtaattcttgcatgccacatcatgttgctgcaaaagcaaccagaagtcacagttgtccctagaaaaccacagtgactggacacattccctttgtggctgtgccagaatgagttcctgtcatctgttcccacctcatttatgaggcatcaccttccaccttgagtcgaagcttcactgtagtgtgatgtgactgcaaagaagaaagtaagtgtccttaaatgaatgtcatcctgagctttacacacaaacctttctctagttatcagagcttgctatttacacagggataacttcttatgcctctagtatttcacaagcactcactgaaaggttgataaattgaaaagatggcatctccttctctgtgtagtctttgccagtgtccccaaaattgctgtgctctattacataatacttccttagccagattccaagaattctataggctgtaattttatcctaggaaaaccagaggatattaaatgatctaaactgtcttaggcagaaatctctgacttggctgccctttgaagtttgtatctgaaactttttgatgtcttaatattgttttagaaattggggggtgaggagttgactttgtaaatcattttaggattgcaaaaatgacattatgatgatgaatggcacaaggctttaaaaaaagtttctctgaatattaaattaatcacaaaccgaggctgtctaacattagctcctgataacttagagatcctgtggcattccagatgctctatgaaacagaaatattctgtctttattatgagcacctttccacatctgcaattctgttatacaataaagtcttgttcttttgttgcaagattgccctggctcatttttttattattaatttaaaccatgtgggtaaagggtaatccagtaagccataggatttcagatcagagctttcatacaaccataggtaacatcaaacatctggatatctagatgaataggggtaggggggaaattaacaggaactaaagcattgtatgaattaataaattttaattgtatataattttattcactttgaatatattttcttaatgtgtcttctttaaagatagaaggaaatagaaataaaaattcataactcaattggatcaatcacatatgaatgcctaataaccaaatagctttcaatgaaaaaacctatggctattaatatgttataaattgcttgactagcctaaagtcacttttattatactgattttattacatttttattatattttaaaggcatgtttaataatccacttaaagagagcatgatctactagctttcttagaacgctaaggcacagggttgtctatttaacataaaacggtctcagaaatattttgcctcaaagtactgagatatattgtggatttaaatatccacattacttaattataaataataaattaatatttgtctttctctgtttttgttttcgttttattgccaattcctgtatttttcctaactcctcttccatgaaagctttgggaaaataagtcatgatgatgtacaattaaaaaaacagtctttctccgggtttcaaatttttacattttcccaaaggacataaaatttccagacaataaatagcataaagaaaatatttagatatcttgctaattaataattctctcctgcctttataaatctgtttgaagcagaaagttacacggaaactttaagaagcaaaactcgtcattcttacaaataaactaggctaataacactctttagtattaaaagttgagaatagtaaatgatcctactcagtaccaaaaaaggaggaataataggtccatctaaaaaagaaagttaaggttgaccccaaaaatcatggaaagtttttcctgcagtccaaatcaatttattttcaagcagttattcttaaagatgtgcctgaatggatgttatttgcattctttaatccagatgctgtgcattttactgcaggtgccaggtgtggacattcaaaggtaaaaatttaaagatcaaagaagcaaaggttgatcctgttgaaatatttagccacaagtcattcatatgactagagactttttgtttcatgaggtgtttacgtcctttgttgttaaaactatttattacctttgaaaacaggtcaccttcctttttgcaatactatagagtgtgatatggtcttaatgtgtgttaaggaaacatccacgtttgcaatgaaaatcgccaccattattccttcaaatgtaaagtcaatctttttgattaaaaaataaaaacaggtcaatgttttacttagagagaaaactcaagcccttaaataaagtgtgatgaaaagtagaaaaatataacaatgcaaaagctaaagtaaataaaaagaaggaaataatgtaaaattcagttatctccaaaaggtcactggatgagggtcattgggcaaaagtcagagtcaccatgcagcatgctctctttcctcaacagatttgaccctctgactttagcatgtctttaatcattaattaacaaacattttttaagtaccttctgtatgccaagcaatgtacataccaatgaaaacaaaagagttacttctttttagcagcttacagtctatttgaaagagacaaatataccaaatttttcagtatactgtaagacgtattagtttgaacaaagttcaggtagccacagaaacattaagaaagaggacacctattttagtggatcagagcagacatcccagagtgatttctactctgagactagaaaaatgaacattaggcttagtcagagaaggggaaagaagtgagtgatcctgggagaaagatgtgtgacttcccggagatgagaaagtacagcaagtatatatatgcacatgcagaaaatgagggctctaaggcaataaatggaaaaaattaataatgagaggtaaaaaatctccagatcatgaagaattgtttttatttcttctcatttccactgctccaagaaggaaatattatcacagctcaactcgcactattcattacttagctccatcttaggcaaggaattatttatcctcctctagtctatattgcatggcatatgttcttctgaaatgtagacttaatgtattttttaaaaatagaaatccagaatggacattttacattgttgtctcaacagtcacttacttatgaaaatattatgccagatcttcaggacaaatagcaatggggaaggagtagggttccgctggaacttttgccctgctgaagtttgcttgaaaatagagaaacagtgaacttagccattttctaaacaatctgccttgctgctacttttcattatctattatcatttaaatgggcataatagtaatattaatcatagtaataactttgagaattgagtgcctgctagacattctcctgagtttttcatgccgtctttcatgtgttcttcacaataaagacttctgaattggtttcagtcattatcttcatttacagattaaaatactgaaggtcagtgatctaggttgtttgctggagattacaagtctcgtaagtacagatccaggactcaaagatagaacgtggaaaatatacaaatattcagagataaattttcatatactctgataacatatccacagttccaaatagataggagtgtagattcaattacaaaataataatttcccaagtctgtatagtccctcagagaaatgctaaatgttctctgtggggacgacgaaagagtttctgggaaaaaaaacactctttagcgctctaacaatctctcattactcttaatcactttcagactcattaaccttatcctcagttgcaaacatatgtgtctctttttctttcttgtcttctttggccaatagatcactgcagtagtaagtttcaaacacagtccaatctttaaacattcagaaactacacaccatttcctgtttcctcctgcttttcatctcagtatcacagatagacacaaactcttagtgaaaaagatcacatgacccccattgatagattttatttttgcataattaccataacatcttataatcctgagtaacaatgtggagatgaagtgtacctgttgtcaaatgcttcatatcaatcaccccaaaacttaatggcataaaacaacaattcattatctcacatcattctatgcgtcaactgagctcagctgactcattcttgtttggggtctctcatttgattacagtcagatagtggctgggtctaggttcatctgaagtcttttttacccacacgtctgatgcctgtactgaaatggttggaacagcaaggagttgactagacatctttctccaagtggctatccatgtgactggcctaggcttttccatagcatggccctcccagcatagtcagatttcttacctggaagctggctgccctcagaatgagcattccaagaggttagaattgaaaactaactgccactaattcttaataggtgggcttagaaacatacacaatgtcacactatcatattctattgaccaaagatatcagaaactcctcagattcaagaggtaaggcatagacactacctctccatgagaagtacgttaaataatttgtgggcacctctaattgaccatacatagctctcagctggaaataaaaacaatcttaaattttattttgaaaaacaatttttttaacattccaaatttctaaagcagtgaagtaaaaaagtgtcatcattcaatatgcttaatcattgttcataaggagaaagtaatttatattctgttagaaatttaaactttagttaggttacaactagtacataatgttgaccagtgtccaagttggttattcatgttagccatgagactgaaaatttgatagatggtattatttatgattcataatttcaactcaaatgagatgaattgtcaaagatgccaagattcatgatgacagggcagaaaatggtaattctttcatagtacttacaagtattttttaggtaagaagttatgacagactgcaagcaaataatacgctactttcaaatgagttcataacaatatcaacaattttcatatacttgcatgggagaatttttctttccataagtactttttaacgactacataaacaacactcaatattcacacagaatttaaaatacaccataatggcttgattcacttcattagtaagtctgtgggaaaatcagtggccccttaatttgggattaaaaggtttcttcctatggcctttaatttaaattgtcagggagagaaaaaggacatgagtctttaaagttacatatactaatgtagcctatctcaaatacagcgtttactgacctgtttcatgctgaataaaatttatgaccctatctacaagggaagtggtaaaatgattgtttgttatgatgagaagctggagatctgtgagtccaccactgggaaaggagatagataaaaatgtggatttgcacactataaactacatgcagaaacagggaaaatattgtatgcatataaaaatagtaacatacatatgtcttaaaaaacataatgctaagtagagaaacctaagaaacaaccagatctgtgcaaaatagacgttttataaaattaatcaaagaccaagaaaaagtacaaatgataatggaaccaaaatccatgtacatgccaaatattaaatgtttcatgtttgtttcagatttgcaaattaaaacctaaagctaaggtgaaattctttatattcccctcctactcctttcttcccatttatttcgtcaaaaaaaaaagctatggtaaaatcataaatctgatatgcatctaatcaatgtttttaagtaaattgagtagatatagatatacaggtattgttgaaggttgggtcctgtgaaggcaaatgttgagacagaatattggatgtaaaatattttttaaggaccaatgtctatcaagggagtggagagagagtagggttgggcagaggaagaagtcactggggtgcaggctcaacaaaggctaggtcaacccggcagggagttctggatggaatattatccaaaagaatatccttcattgggctaaaataacctggccctcctcattcaatcactaggtgtgggatgccacagaaagagcataacctcaagcaagatgggcccctgcactatggaaaactctaaagcagggtgtccctaacctctgggccatggactagtactggccatggcctattaggtaccaggctgcacagcaggaggtgagcagtgggtgagcgagcaaagcttcacctgtatttacagccattcatcatcacttgcattacctgagctctgccgcctctcaaatcactggcagcattagattctcataggagcgcaaactctattgtgaactgtgcatgcaaaggatttaggttgcgtgctccttaggagaatctaatgcctggtgatttgtcactgtctcccattgtccccacattagacaatctagctgcagaaaaacaagatcagggctctcagtgattctacattatggtgagttgcataactgtttcattatatatgatgatgtaataataatagaaatagagtagcagaatataatagaacaatatagaaatctcattatatattacaatgtaataataatagaaataatgtgcacaataaatgtaaagtgcttgaatcatcccaaaaccatctgtcctatgcctggtccacagaaaagctgcgttccatgaaactggtccctggtaccaaaaaggttggagaccactgctgtgaaggatctaacaactggaggctctctgctgatattccttgcagttgggcagcaaaatctctttaaagtggaatctgggtggcatctctctgtgtctattacatatagatagatatataaatagatatatataaatatagatacagacatagacagagacatggatggatatagatatagatattacagatctatagatatagatatatacagatacacatataactgttgtatgagggtatatatccaaaaaataatatatagcattgtgtttggttatttattattgctttaaaaattacaccaaagtttggtgaattaaaaagaactcaattgttcgctcatgagtttgcaatttgggcagacctcagagaagacaacttgcctccactccatggggcatcagctggggtgtcttaactaaggcttgagtatttacttcaatattggttcactcacataaccaacaaattggtgccaaccatctcctggaacatcagctgggctcaattacactcaaattgtgtatcttgatgtaacagcatgggcttgctcacagcattgaagctgaattttaagaaggaaaaagaagctctcaggccttttatatcctggtctttgcaatctagaccatcacttcttctacattccattggaattatgtcccaacccaagttcaatgggaagggaacataagctccacctcttaatgggaagagaggcatgtacatccagggaggagaataataatttgtggatctctggagactaactatcacagcctagctactggccacagaaactcacatccctccatgtacaaaagaatttcacccatttcaagacccctaacagcctcctttcattattgcatcaactacaagttgagaatttcatttacatcaggtctaagtagagatgagtctaggcacagttccttggaagaagttccttgagaatggttctcctcaatatgaggaaacaaggcatctgttcacatacaatggtggaaaagagacaggaaaacttcaacgggtgctccaattcaaaaagggagaaggagggaaggaaggttcatagtaatgacaaatctattacaaagctaaacacattaaagttacttaattaaagccgactgagttgcctgagagtggcttaccatgacacatggctctatcttcacctgtgtgtagagctaaataactttgtctgcttcatgtctacagaaagttaaggacctagatacatcttgttataaaattcctctgttccttttaattcaagctaacataatttatttaaaattctgatgggcttcttttttatcaaattataagccatattaaatggcatacgaataagctaaatttgaacctccaaggaaaggaaaagcttatttgtgacttagctaaacagatatgataattcatgttaaaattcagacttcatcttataatcaaaaataatgcttttattcacttatctaacatggatctaaatgcaaaactttaattgtgtttgatagcattatgtaaattgaaaaactgcaagaaattttgaagaacattttgtcgatattgataaattcataattttcaattttaccaaacccttttgaatttaatgttaataatgtgaagttattgaagatttagtgaatttacttaacttggacagataccatcttgaaattaatatacttttgttttaaagttctatcaattcctccaataactgaatcagttttatcaatatgcatttgaatgttaataaaaatgatttggggttctcaattaagttattggaaaactggtaagtaaatgtgacataatttgagtatatgaatctaccttttcaactatacattttatgaaatttaaatatacatcaaatatatacaatgaaaatttggtgtccaagttatgttgtaggtgtaaaatatacattgaattttgaatacttagtattaaaaaagtaaaatatctcattaacaattctgtattggttaaatgctgaaataatgcattgtgaaattgcattcaatattatatttatttatttcacctgagtttttctaatatggctgtgtccattatcaatttattgcatctgagtcccaaagtcacccttatgtacatgctctgtgataatgaactgtattcttaaacatttctccttcataggcaatatgattttaagctttgtcagttgcaggtgctagagggacattgcaggatgcagaagacttctcttcccggttcttactgctgagctttggggttttatcttgttcctgataaacaatcactccacatgtgggtgcttgaggacatttatttgttggtgctcatccctaactatgtatccagggtgcacaggccctcatcaccttcccataacccttctgatacagacaccacacccacaagagtgccccaaccctttctgaatacccacctactagcctcagcttgtcacaattgcaccctcgaggattgttccttgctgctcagcaactgtagaccatcactcttgcccaggtaatctagcaaattgtctgctgtccagtgagctgaaattataattttttccagggagtatggacctcagcctgaaagaggtcccccactttcaaggttatccttccttgactactcttcctcagctctaggataccttttagagttctttttaaatcttcctagttttatcttagcttaataattctttatattaaacttcccctatttaagttactgtgtgatttctgtacttgattagactcagattattacagggtatatgtgaagaaaaactttaattacatatatgacttacattatatttttattagatagtgctgctaaagagtatatacctagagaagatagggagagtgcaagtagttggaaaccttgaaaacaatgacaaaacattaaattatattttaataaaattaagaattaaaaatcaggtcaagcttcaagagacagatgaagtatttgaactggcacatcaaaatggcattgaaatatgattctttctaccatgactcaaatatttttctgggaaaagtctgaaagtctacctgagaggttagcattcttgtcccattgaaagatagtttaagtgccaaactacagctgtagaaaagaatggagaggaagagatagatatgacaaaaacaaaaacaaacaaaagttaggagtaaaattggcaaactagtctttagacgaaatagatatgtctggcaaaggccaatgtgatattaacgataacaccaaagtgtacagtttagtcattattagaatagtgatatctgaaaacaaagtttgttcctaacaaactgctagtctagatctccagtagcatgaatgagtacaagctaacctacaaaatagaagcatattttaaccttatcacttgaatttaggtaagcaatgttattcaattaaaaatcacctgcttaacaaatctgtaaaaaagattttaaaagggctttaaaaggggtctttttaaaaagggctaacaattatagactagtaagaactgccccaccaaactgttaaaagttagatagaatctcactattgattgttaaggcctaatactgtctatgtgagcaaggttatataataatattgatttcatgtttaatgtgaaataaatatattattacttttcaatttttaaaaatcgtaattaattttgttctatgtggcttaaaatacgattatttatgtactttatatataataactgaataatctttataacattaggaaaactaaaagccatcagctaattaaaagccatacccattgaacagcaaaggaagggaattttactgcaatgtaaattccagtactccaactataatttcagtcatgcaaagaccagactattaagccatcagaaaaaataatccatggaaaaactgctgattccatgtattttttactgaatatagccctaaaaatatgtttcagaaagtttgtttagtattatataactacttgggttatgtggttttcatattttttagtctatttactaaaaccattggtcctacatttaattgttcaccacaaatagagactttccaagctttcaaaataatggaattacattaaatatcatcaatatttaggatgagaattgcattacatttcatattgatgataaatgtaatcaagatatttttaaaaacatgttcagtatgtgtaattcactataaaattttatttaaaatttttctttgaaagcctttttcagagttaccaaaatcaattaaggcaagtacaaactggattccacaaaattctatctgcattgggtgttacaaacataatctaaacaacagggtccaaagcaatcttactgaattgcaggtgacacaaaactagacaatataagaaatgcataattagatcatgggccagataactaaactgataacagcttataaggttttgagaatttccaggtttagacttcaagaacccagatccattctcaagtcaatagaagtcacattctccaaacctttcagttagcaactattaatcttggtagcaccccacacattctgctgagtaatttcacctctcatcaactcaggagagctacagaagtagcttaagggaagctttgcctatcagacacattcttttcttttttaagataaaacagctttattgaggtataactgacatataataaactacacatttaaatacaatttgataagttttgatatatggatccacctatggaatcatcaccacaatcaaaataataagtacatcctttgccaccaaaagtttcctcatctcccttaagaattcctctcggtaaagcatgtacccctagttcactggccactgacctgctttcagttacgatagattagtttgcacttactagaactttacacaaatgaaataatagaatatgtacttttatctattttctttcagcatatttaagattgatttctttttataatgtgtactaataattcattcctttttactgctgagtggtactccattcttcagatgtatcacagtttgtccattcatttgttgatgaacatttggatggtgtaccacaaaattataagaaaggttgcagctattacaagtaaatctgctagaaacatttgtgtgccacatatatacttttatttctcttgtcaaaataactaggagtaaacagctagatcatagggcaggtatatgtttaacttatttaaaaactgataaaatttttattgtgcagtcataacattttacattccaactagcagtgcataagaagtccaatttctccacatatttgccgacacttagtataattagtctctttaatttatccacttttgataggtgtacaatgatatctcgttgtggttttaatttatatttccctgttgactaatgatgttgagcctttcttcatgtacttattattacaagtattttttctttgctgaatttttgcaatatttgttcaaaaatttgcacagctttttactggatggtttattttctaataattatgttttcaaagtattttcaatataatttaaatacacttcctaagtatttgaatatgcaatttgaaaatcgtttctcctagactttgacttttcttaaccatgctttgaaaaggaaaagttttaattttgatgaagtctaatttatcaatttcgtatttttatggatcatgcatttgaaatcaagatcacatagtttttttcttgtttttttttctaggagttttgtagttttatgtttacatttatggctttgattctttttgaggagaattttatttgattttaatatacataaaattaaatttactgatatggcattacagaagaaaggcatagtggctcgttaagtgaccaaaagttacaaccacaggttaggtgatgggaagattttgcagactgtttgaaaatccgaccacctgagaagtttttcatatttttttccattgtctctttttttcaggtagtagggtaaattcagtgccttttcatatacaccatggaatactatgcagtcataaaaaatgatgagttcatgtcctttgtagggacatggatgaaattggaaatcatcattctcagtaaactatcacaagaacaaaaaaccaaacaccgcatattctcactcataggtgggaattgaacaatgaaatcacatggacacaggaaggggaatatcacactctggggactgttgtggggtggggggaggggggagggatagcattgggagatacacctaatgctagatgacgagttagtgggtgcagcgcaccagcatggcacatgtatacatatgtaactaacctgcacaatgtgcacatgtaccctaaaacttaaagtataataaaaaaaaaatcagtgccttttgctccaccttgcctaaaaatggaagtcacttgttttttattttattaaaagcataccaacactagaatctctgtatttcctacctgaagaactggaaaaaatcagaaggatgtggtggcagagggcagggaaaatgttttatatgtcagatgtccttttaggtattatggcctatccctggaattcaaaaagcataaacatgtctaaagcaaagagaaaaactgagagatggttacagggaagttggcagtgatcagattactggaggctttgttagtcatatcagagatttcttaatatatcctaagaatgattaaaatcatttaaaggttataagcagggtggtggtgatcagatttcccatgttaaaataatcacatttagctattgaatgaaatatatgttacagcagggcaagatattcagagaccaattaggaaatgggaaacattttgggcagaggagtgaaataatgtaagtcaggggtgtagaatgagaagagtagggagtaccagggcgaataatcaggaatgagaaaatgtattcttgggatggctaagagagatgaaagagggcaggtgagggtaaaaggtaagtaaaaatacagggtgagtctgaagggtctttaatagtactcaaaggatttgaggattttatatctatacgattttatatatacatataatagtttaataattttgttatatagacacagtattttgttatttattttgttatataaatatatttgggtgtgtagctatacaacaaaataaataaactattaagaaattgaaggttttgtgtgaaagcgtgtcagagaagttctttattgataataatatgtcacatggattaagagatagagataaccttcaaagacatttggagataactgcagatagcaaatcaaaataatctgggattcaagtagatttgagaaaatggaaattgatattagggcagaaatttatttagatggttttaaagcttatataatttattcacactccctcattaaaccaagctcatttcccaagtctgccttagatgtagatgattgtgtcttataaacctaaaatattatttagctaccgaaaatgttttatgagctttaagataccctaaacatagtattttgtaactgtttttgtagtatgcaaactttttaccaagtttagcattatttcaacctacacaatttttcttagaattagcatcttaaccataaaaaccatatccttttattgatttctaccctaatctacttaagcatttagtagaataatggcagtaaaatgatttaaaactgaaatgaaacaaattaacatctttacaattatcattatttatcaataaaggcaatgtgataatggatcgatgcatatacatttttccttccctttatggatgaatattcttagcaaattcagctctctgatgaacaaaatatatccagtgtgctgtaatttgagatttgggttttaaccatttgattcaaacattgcattacacaaatcactgctgatttttctgttcgtttaaattaccattactgttttcaaaacaagaaaactaagtcacatcaatgaaatgaatgctcagattcactaaaattattatcaccaaagaaataaaatttataaatggcaacttcagtaactatacagacaaatatacatatttcagagcactgtgtgtctgtgtgtgtgtgtgtgtgtgtgtgtgtgtgtgttacatttgaatatagaatcctttaagaaaatatgccccatacctaagaaccctgggaagccatataggagatcacctgacacacaaacataaaacattaatctgagtactgatttatgccttagcaatataatggtgatttaaaaacccagcagcagttgcagtaattgggacttcatgcatcagattactatcacctataggaagaataagacagagaaggtttttcttttcattttaaatgatactctgattattatctttcaaacctcagaggagaattattggtttaatatgcttaaaaatctattccattttttagtaaacaatgtatgtaacttgaatttacctcatgattgtatttttaggtttataacttattataataaagtttcccaggctaatagctcaatacaaatattctagttcatgtttgttattattaattccaaatatatctcatctttcttcctgttggaagtgttgaccgcactggttgtataagaatccagctttgattggaccttataccacagggtcagaaagaaagcaaagcaagtcaaagataagattgtactattcaggtaacactattttcctaacccatggctttcaaatctcactgcattttagaattctttggagaaattcagcttaaacgctgatttaatttcttaggaatgtggctccactatcaacagttgtcgattcacaggaaattctaatatgcagccaggatgaagaatcactgctaaactaaacctcaattcttaagcatacataacaatctcctaaacagggtaatctctgtatgccattagatattctgattctttgtctttgagttgggtccaggaatcaactctttagctaactggtcattctgagacaggcggtcttcggttcaaatgagagtcatcgccttatgttcaaagctgcgctttgcatttttctgatctgtgttcattaaggcttgtctaaagaatacccccacttccgtagaataaaaagactcacagactcagaaaggaggaaaatgaaatcagaggacaggttgacatgtgaggactccagaaaccttattactttcatacaatggaataaagaacaagaagaagaaagaaaaaccagtaggtggtcagaagcttcacctttgcaagttctgcccactaggacgatgacccaataaaatgtcctagaatctccatgagaaattacttatcttccttggaaatgaagtaagagaaggactagagagaggacttgtgctcttcctaaaagccagtgttctctccattactgttacttagaaatatatcttgattgatttcttcaggactatcactgtcacattatgaacctaattctccataacgttaaacaaattaagatcctaaagatagcatactttaaatgattggatatgtgatatataaaacttcatcctacaatcacacaaatatgcatcaaaattactctgctcttcttagagaacgctgcagtggaatattccaggccaatatttaacctaggtaattaaactaatccaccaaagctttaatcaagttattaaccatagtcatatcatactggaaaaagactaattccttctggagatacacgataaagaatgaaactgatcattcaaatacaagaaaatttctcagtctagataggatgcatgtcatggttgaagacaaggcagaatcagaggtaaacagactgcacatgcactgtgccaaatacatagtaagtgctcagtagttttaaaaattattttagtattataatatcagtcatggtggagcccctagcctagtggaaaaagagagtattatgagatctgaggatcactgaatgaaaatatgaggtgagaaaaatgggaaaagagaaaagatacaatatggaaaccaaaaaattctaaggacccagggtcccactccactataatagtgtgtgtgtagagtgtttcttctcagatgacagaaagtaaattgacaatggctaacaacattatggtatttcgttatgttgttagtttcttaattccaagggtattactgaaccagctcatacttgccctacacagtttttgccttccatagaacatcaagttcaaacttgatattcaagcaaggtcaaggtcaccagattatgagctagagttagaacaaaactaaccttgcaagtctttatctataaagtacagataaattctcaaaaattttttaaccatttgatcattttttctctaatatcttaaaaagcttttttaatatctaattatctctaccatcttgacttatgtctaccatcttataactttaccctataatgaacataaaaaattgatcacagaatccctaatgcattcacagagagaaagagagagacagagagagagatcagttagcctataacaaccatcagattagaattatgtaaagaacctcaagcagagattcctactgaagataacccatctgctgctaatggttccaagagccacttcaaagtcatctaaccatggaggagaataacagatcaaatctagagtataataatccaggtgggagtaacatactaaattctgaagtctgggaagatagggagaaagactgagactgcatacatagatgggacaaaaagggagtgaaagactccagaacagttctatttatccagcagccattcttgagtgtgggcacttcgcttttaaagggtctttaagttaatgctgtgtaggagggccagtgtggctctcacataaagaaacaggataagctcaaaattcaatctgaatactgcatgaaatcccaagggaatgtattgaaacaagtcttcttgagtctgtactctaggaagacgataaaaagagtatatcaaatcactttgctaaacaagatgattgatataaatttaaggctacttggataaagtgaagggagatttgttttaaaattttgaattttctcttggcacagagcagcacttgtgaacatgctcctgaaggtcatcatctttcaggacccatagggatcaagaagtaatagcttccaccatgttaatggttttctccatccatgatactaaccaaaaggagattctgtaatccttaaatgatagctatcagaagccacaaagaagttaaagacagtggcaggataaccagaaaaccctgcccgaagtttggtgagtcaagaagcaggaaaatggttaggaagccttccatttcaaagttgttagttctgatacaaccagcatttttaagcttaagtaaatccgttacatttagaagagataatataagacagaaataagtacaaataatacccttagtatcattgcttgaaattatttaatggaaatatctaatgaacttattgcaatattcttccttgaaaaaatgacacttgggcatttgcacattgtaaactcaatctattggagacttgcttaaaaaatgaggaaaggagaaacccttctatacagggttaaggtaagtattaaacgaggtaatgtaagcacagcacttaacacatagtaagtgctcagtaactattactattattattattattatcatatcagtcttgagagagcttacaaactaatgagaagggagataattatcatgtgtaactcaggatgcaattttcaaaatttgcttatttaatgcctgtaacttggaatatactgttcaaaacactggaaatttcgttcagaattaaaaagataactcttgccctcatactgagaacagttaggaatgcaagaggcaaatacatgtggtggggtaagggtaagtgaactatgaactataaagaggaaatatgcagaatttggcaagaaaggcttcagactgtcataaaggtataacatctgtgaaaagaaagaggggaggaagtaaaactgggcagaaagagcactagactgtgctgcagatacagcgctgtctcagccaattcaagaaacagctacagcacagagcttttctattagaagagtctcatactgggcaaaaatggtcaggctttactaatatcaccatgttcagtcattggctggagactcagtgagaagagcatgtcttcagcttgaaagttgcagcagattcggtagatgttgcagttgaaggcagtcagctaagtgcactccttagagctgaacaatttcttcctagaatagagatctgagcatcgcacctctacagatgccacacttcactctttgtgccatgtgattcacctctctatacatgagttgggtgttggacccttcaaagttcagttagtctctcttcctgagcaaaaatttagaagacagggattagtggaaccaactataatcccattactgcagttcttgaagttataattggtactccttgtcttccttttccactccatattctaaattttccccacctcaggcatcatctctgatggtcttgggaacttacctagtgatgtagctcaaactagctttcctgagaagtctgagtctggtgtaaccatatcctcctcagtcacgattgagcaagggagggccaagaggcaccaaagtggatcatcggagttcgctacattttcctcctacctcctcctgcttatcagaggatgacggctcctcttcctgcctgctatccctggaaacaacactccaaaatgtccagctggcacccatagcttatgattcaacaggacctttgctctcttggtggatcatttaatcgtttttgaaactcaacaactctaactattaagtcctaaatttggttttcagctttttctcttctcccattgcaggagataaaactttggccttcacactttttagaaattatttgttaactgattgcaacttttcactatttttcattaggacatcattgtggtttattaacaatcagtcaatatcattatcctttgtgtcctccacacttttattacaccacctagtataattccctccactcaaacatcctttccagtcaccctagtgaaatttttagcaaatgtaccacatctttgtgccagggactatctgcattctacccaccatccaggatgagattctcagtgtcagccatgggcggggtggagggcggataacccaatccctaaccccaaactactacttacttagaatgctcccagtaacaactgtctccattcagatacttcatgaataagatactaagacttaagagcaagtcaggaatacaagagatttgggaagggtgggaggtgggatggtaaatcttgtgaaatataaaggggaaagaaacggaattgatgtgggtgaagcttgaggccagaatacgaatctgatatttatgaaagcaaaaagggaaggaatcaggactaggcaagaagaaagtcagactgtgttgcagagctgaaaaaagtctcatcaaagacaatggggagatctggagcaaatgtgggactttggacaagtcccacattgggcaggaatgaccaagccctaatattccttttctgttggggctgtccaaagagaacatggtctaggcttgagtactgtattggctctctaaggcactggaatagaaacatgttagctaactgcaatccttgaagctgaaagaaaaatctgagctgcgcagctccatggctaccatttggaactcatattctagtgaagaaaatcaaaactaaacaagtaaatacgaaaacatatattgtgccaggtggtttgtgtgctatggagaaaaaagcaaggtaagagtgttagggaaggcaagacagaggaggagagtactagtttatatagggtggtaagggatcacccgatataatatagagtgcttctctgataaactgggattatcgagggacccgtttatcagagtgatggaaatgatagagtgagatatgtgaatatctgagaaagagtattacagtcagaggaagcagaaatgcaaaggcattgagtcagataatatttgagaaacaattggctgggcacagtggctcacacctgtaataccagcactttgggagcctaaggcaggagaattgcttgagtccaagagttgcaagcattgcttcagtccaagaggttgagaccagcctaggaaacatggcgagacctcgtctcaataaaaaataaaatattagctggatgttgtggttcgtgcctgtggtaccagctactggggaggccgagtgagaggattgcttgaacacaggaggttgaggctgtagtgagccgtgttcatgccactccagcctgggtgacagggtgagaccatgtctagagagagagagagaaagaggaagagaaagacaaagggaaaagaaaccaacacagctaaaaatgagtgagggagaagggaaaaaatgaaatgtgttctcataggtattagggtgtaaaaacagtgtaatatgtagcaccctataagacatgaagatttcttttaccctgagagagacagaaacttactcagagtttccacttgtctgtcaaataaacatattaaacttaaggtgattgaaatggatctcctgatctttgccatgccctagatctcctcttcctggggtttttcttaggttagttgatcacaactcttctttccaggtacacaggccaaaactttgagatcattcttgactcttgtcttgtcttcacaatctacatacaatccatcaacacatcttgttgaactttcttcaaattacatccagaaaacaatcccttgatatcactgcacccactaccaatatgggttactgcatagcccctcgtcaggtttccctctccctccttgtctcccgtagattctattctcaacacattagccagagggaatcctttcaaactgcaagtaaatcgtcaaaagtttccaatggattacatcttactcaaagtaaaagccaagatccttaaatggctaaaaatgtccttcattgtataatcctgactcctgttaccaaactgacctcatcacctagtatccttctttcccttcacttctttctgtcatagtggcctttgtgatgttcctccaatatccccagcatctttctaccttatcttctttgaaatgtcagttctttctgcctggaaacttctcacctgatatgcacttaactaactccctattgccttcaagtatttattcgaatatcatacttcttcttaataaccctaattaaagtagcaacttgcccccaaattgcagcactcctgatcacccgtatactgaacaatttctcccatagcagtcgccaccttcaacacaataacgattttttaaattcagatacctatcttgttcactgatttatacccaactcttagatcaatttctggatcaaggcttaaatcaagcatttcataagcattcaataaaagtgttttaaaaaaaattgtataatatattgtcaaatttactttgcaatacacttactgtgcaataggataacattattctaatctgttatatgttaatgcaagtgtatattaatgtataatatgaattatattttaaaattttactttttcattaagtgggagtacctcttaataaactaggctcaatcaaatgaaactgcccattttttaggttaaaaatagattgatttttgtcagtttcatgtgtttcaacttatactaatactttcttcccatcataaatgaatagtataatagcaaaaacatttgaaaaaaatattaaattacaaaatcacacatatagcatttagtccccaaatatacaaataacttatagatttaaggattaatgtaaaacctataacatttattacaaagaaaatcacttttaaaaataatattccaagatgtagtataagaaatgagaaaaaaattatttgagcatagtagtttatagcatcctgggggatttttttcctttatacctctctaattttccacatttacaaaaaggaacaaagattttggagagggttcaaacaacaactaatgtaagaaataatataactgaaaatttgaaagatagatttaccccaaaggctaactgaaatggaattatttcataggaagagaaaaaacctgagatgaaaaaagtaatgacagattttaagcagtttttataaattatactttaaaaatagatgtaaagaagcatatctatctgcttaatcttcaaatcatcttctggatttttaggtgccagcagaaagcataccactttaataaagagatatgagatgcgctagaagtatactcccacctttgctctctatttgagagctacagctgtactctgcaggtcatattaagtcccagttttctgttgctctgccattccctaaggcaggtgtaagcaacctattacctgagaaccacattctgccttccttccacttttgtaaagaaagttcttaatagctacacccattcagttatgtattgtctatgccactacaatggcagacttgagtagttgtggcagagaccatacagcctgcaaaacctaaaatatgtactatctggccctttacagaaaaaaagtttccaaatcttgccatacagtgatatcctttgctacgtggctaattctagctcactaccaacattcccacattttaggcaatgagaagaaggcaacaaaaccaagcagagggcacatcatttgctatccaaaagaccaactttaagttgcacatatcaatgctactcattatcccattggcatcaaggtagtggggtaaaaatatgccatctaaaatatgtgtgggtggttctattaccaaaaggcagaaagagcaagtagatgttgaggaacaacgtgcagtctctgccagattatctatggcacaaagaaggtaatgtaggtggacaggatcagcagttgttgcctacatcatttaatttggcaacattagacaatgagattagttcatcttaacaaagagaagcacttcacacagtaaaagactgttctgtccagtaactttacctcttccttccttattcctagttgaatgtaatttacctacagcctgctaatactaatatttgaaagagtagatcatcagatttggtgtttcttgtcagtgattaaaaataagcattcaatctctgcaatggtaactttaaggcggtatgcacacctcctgtgcagagctgcttcttgttactctctaacacctcagtgtaacttcaaagacagaagctacagattcagttgtttcaggagcatttttatattctcttttcacctcccccaacccatgtgagatacatatatacgcataaatctaatatacactcaacaaattcatattcacttatatttctgatggccttatcttggcaagtatacatattaggtgtaccagggtaccagggaatatggagataggctcaataaatggagcaggagtgagaaaactataacccaagggccaagtccagccccactgcctaattttgtaagtgaagttttagagaacacagcgatgcttattcatttgcacattgtctatggctccttttgtactacaaaactggagttgagtagttgcaacaggactcatgacctgtacaatctaaattatttactctttcatccattaaagaaaatgttagccaatccctaaactacagcattctagagtccttatttttatttgaacctagattataatcaaaatggcaagaaattcgttggactataagcaagaattttttaactataaatatagttaaaaatatagacaaatcctagaattgatttccttttatatttgaattcttttcctagcactcctaagaacagaaaaagttcttatttagtttagaaattttttcataaaatgagtaagtttaataaaatatgatagtcttttcaataaatgtttctgggtcaattgaaaaccaaataaattttgaccaccgccttcattactcataccatacagaaatcatttctaggttggttacagttctaaatgttaaagaaaaaacaggcttttagaagaaagcataaaataatatcttcatgatggtaaaatatgttaagatttcttaaacatgacataaacaacactaaggagtaaaaaagcatggttttgactacactaaaaataagaacttcttttcatctaaagatattaaatgattcatacttcctgatttcaaaatttactacaaagctacagtaaacaaaacaatgagattcttacataaagacaggcaaataaaccaatgaaatagaatagaatgcccagaaataaaccctcacatatatggtcaaatgatttttgacaaggataccaagatcattcaatagagaaaagatacttttttgtttttgttttttaacaaacggcatcaggaaaactgaatatcctcatgtaaaagaatgaagctggacccttacctaacaccatatacaaaaactaagttgaaacggatcaaggacctaaacataagaacataaggcctaaaactaaaatctcttagaaaaaaagaaaaagatttacaacataggatttggcagtgatttcttagatatgataccaaaggcccaagcaaaaagaaaatatagacaaattggacttcatgaaaatgtaaaacttttgcgcatcaaaagacaccattaatagagtaaaaagacaacttatagagtgagaaaagtatttgcaaatcatgtatctgataaaagattgatatccaggatatatagagaacattttcacttacatatacataaagaaacaattattatttttctcagaatacttttcagatgtatacaaggtttcaaaatgtataacacatagaatgagtcatagaaaatttttatccagtaaagttcttggaaaaaaaagacacaacccaattcaaaaatgagtggaagacctgaagagacatttctcaaaaaaaagatatacaaatagccaacaggcatataaaaagatcctcaacatcactaatcattagggaaaagcaaatcaaagctgtaataggatacaaactcacacccataaaggtggctactatctaaacaaacaaacataaaacaagtgttggtgaggatatggagtaacgggagcctttgcacagtgttggtgggaatgtaaaatggtagagccactgtgaaaaacagttcagtggttcctcaaaaaattaaaactagacagcagcacaaatgagcctgaaggacattatgttaaatgaaataaatcaggcacagaaaaataccacatggtcttattcacatgtaggtgccaaaaatgtggagctcatgaagcagataatggaattgtgggttttcagagtcttggaagggtagtgggaagggaggatagaaagaggttggttaaagaatacaaaattatttttaaaattaaaaacagagttaccaaattattagcaattccacttctggggacacatccaaaaaaattgaaagcagggtctcaaaatgatttgtagatatccatgtttatagcagcattattcacaataactaaaatctggaagcaacccaagtgtccatcatcagaggaatggataaacaaagtgtggcatatacatacagtggaatatcattcaaccctaaaaagaaaggaaattctaatgtgtgttaaaatatagatggctctttaggacattatgctaagtgaaataagccagtcacaaaaagacaaatactgtataattccacttgtatgagctacccagagtagtcaaatttaaagagacggaaagtagaatggtggttgccaggggctgaggaaaggagagaacgaggagttacttttttaatgaatatggagttttcattttataaaattaaaagagttcttgagatggatgatggtgatgcacaatatgatgaatgtatttaataccaccgaactgtacacttacaaataggtaaagtgataaattttatgttatatgtattttaccgccataaaaattggaaaaaatataaatgaattttttcttttttttgagacggagtctcactctcacctagactggtgtgcagtggtgtgatctcggctcactgcaagctccgcctcccaggttcacgccattctcctgcctcagcctcacgagtagctgggactacaggcgcccgctaccatgccaggctaatttttttgtatttttagtagagacggagtttcaccgtgttagccaggatggtctcgatccctgacctcgtgatccgcccgcctcggcctcccaaagtgctcggtttacaggcgtgagccaccgcgcccggcctgaaatttttaaatataccataaagagagtcaaaaggaaagccacagagttgggagaagatatttacattacatacgtctgacatggaacttatacccagaatattcgtacaaatcaattttttaaattagaaaaatccaataaacagtggagcagtactttattaaagagtcagtaactaatcggctaacaagaaatggtgctcaattttacttatcatcagggaaatgtaaattaaaactgaaatgtgatacccatacacatctttaaaacagcttaaattaaaaagatagaaaatggcaagtattggcgaggatgtgaagaaattggaactccaatatatcatttgtgacagtgtaaattattacaaccattttggaaaacaattttatagtaaccactaaaactgaacatatgcataatctattccaattccaggtgtatcccaaacaggaaaggataaatgtactcacaaaaagatatgtacaataacctctatgacactgctatttgtagtaactaaaaattggaaactatccaaatgtccaccaacaagaaaaggaaagaacaaataaatagtggtatatttacacagtgaaatattattcaacaatgagaatatgcacaaattgcataaataaaatattgactgaaagacacaatagtatacagaatataatttatttttatagattatgcatatgctcactttgtgaaacagtctcaagctataaacttaactgttcttacattacctcaaacttcaaaaaggcattccatttcttgatttgggcactggtttcatggatacattcactttgaaaattcatgaagctgcatgtatataatttgcgaattttaaagtacatacactgagcttcaaaaaagtttacctaaaatatgaaatgaaaaaagcaaaataaatggatatatattcttctatctctaaaaccagccgtggtcacaaccatacataatttgaaattgaataggaagaagacactggtcccttctccaggtcagcggaaggagtacttcttatgcctttctcctacaatcatcacagacatctagcttcgtcatatctttatcatttgccctaaaagttaatgtttctggaataaaagaggaagggacatgaggaaggaaaggtagggtttttttaattggggggatttatatatttgctttactccctggatgctttatttatctacctttctcccctttgcaccattaaacccaggcttcagctcattcaagaattactgcttaagttattcttggtcatttttttttctttttgctttgattctgaacagtttaatagtataaacaaaatgttttatgtctaataggaatggtcaatagaaataaactagataatcaaataagcaaaactgattgtcatttcataatcatttcttgaaatattttgagtaaaatttgtgaggagttatcaaactttttataaatgcctccctataggtcactgaataactgtaaactataggcctagaacacagaggaatcaaggttgaacttagcttcttttaatcctcaattgagtttttaaaaaacatctctctcttaactttcaaatctagaaatgaaaataatgattccttccaataggatgaactgtaacatcacttggtactttataaatttactgcttttgccatatatatttactgtggaaccaaatacccacaaaagtcttctaaaaataaaatgaccatttcacaataagcagagaaaaagaatttcagttattcctataattaattataattataaatgaaataactgtaactgttaatttatataactaattataattataaataaaaacactcataacttagattttaacattttttgctttaattatattagcatgattataaccttgtaagataaacagaaattaaggtggtataaacagaagtgtttatcctgggatttttatgatgaaataaaaaagaaaatattttaaaataattgctgtaggtgtacctattaggacatttaaaaaattcctaatactttaatacaagtatttcaacccagttctaggcactggttccattacttttgctacagttccttttgtgatatgattattgaaatctccattctctgccagctgcagtggctcaggccagtaatctcagcactttgggaggtcaaggtgagaggactggttgaggcctgagcaaaatagttagacctcctctctaaagaacaaaacctttagcttgatgaggtggccagtgcctgcagtcctaggtactcgggaggctgaggcaggagagttgcttgggcccaggagtttgaggcacagtaagctatgattgtagcactgcgctccagcctcgatgactgagtgaggctctgttgaaagagagaaggaggaaagaaaaagaaagaaagaaagaaagagagaaagaagaaagaaagaaagaaagagaaagaaagaagaaagaaagaaaaagaaagaaagaaagaaagaaagaaagaaagaaagaaagaaagaaagaaagaaagaaagaaagaaagaaaaaggagtaagggggagggagggagagaggaaggaaggaaagaaagaaggaaggaaggaaggaaggaaggcaagcaagaaaggtacattgccttggctaaaatcataaaggagttcagtccaatgaaactatctctttagtctcatgaaggcttctgacccccattttatgaaattttaaatttaaatatcaaccatgttttccttcattgttttccagtgtattatattgcgaaactagattctcaattgactgaggtgtttaatccacttgcaaatagattgtaaatgaatacaaaataagtcactgagaagcatttaacataatttaaaaatcaacaagaaatttgtccaaatatttaataacatattaatttaaacgagggttagcaagcatgttactacttttttgaaacaaaaatcagttctcccatttactagcttcatagccactgttgacaatcctattatttatttttcagccttccctttgaaagatgcttagcaaaaatcaactaagtaacaaccaaagatctcattctctttaacatcttccaggatcacaaatttcaattattctctgcctgagttatcacaattcaaactggagaatgaagagtaaacacaagcaaaagaagataaaatctattaaaagatcgagagacaccagacacaaatgggttaaaagaagaagaagaattaaaggttatactgttttgattacacacatagaggctaggaagaagaaaatgaattgagattacctgttagaaataggcggtttctggtttctgggagctgtccaatgtactgagtgaaccatcataaccacaacttacccccttaatagggactgacgtcctgggcagttctcttttgaaccgggatgtttctacattcatctttttaggctatttcttccaatctacctttaaaattatcttctaatctgtcactttgacacaatgggtcttttaaataaatctttacacagtactgaataattaagtaaatatagttattggcaaacaaagaaaaagaacctttttgttaaaatatttgggatactcgagataatataaaatgagtaatctcttatttttcttatgccaaatttaaaatctctttcttttctcaaaaataacgatctaacgatagccaaaaactcccttaaatatatttcaataaatcattgtttctgcacttaagtcttactgtaggacaatacaaatcaatgaggaaaatacgccagatggaagtgttaggtttttttctttgttcgggaacaaatactcgatccgcaatttaaaagtccgaagactcctcagcagagggtgagctgattgactctttggcttatcaagggcaaatcgcatttctgaaaagagcttgaagtggttttgtttgtgaggagagtttgctttgtcccccacactgaaaagtatacagcaaagcccgagcatagaaaatatcctgagcttaaatttctcattttattgccatcataacttttcctcttggaataaaatcctctattttatatgagtaggaggtaaaggtagggaaaggaaagtcaagtatctcaattgttacgctgattgcatccaaacagactttagaagtcagggtttgtaacgtggcaggagagctgtttgcgatgccctggaaagaaaagaaagccggttccaacagcgactctggggaatgcactctcggtccccctgccatgcttacttaagctaattgaaggtcttgcctttcagcagccgctgcactgggataccagacaaacagctccccttgatgccaggcaggcagggcccctcttcaggacatcattaaaagcacatgcacttgctccacatccattggcagatggtggcaagattcaagactcctaccctgaagtcaaggagaagccatcgcggtggaaaacatcctcgctttgaaaatccaacacgaaattaaagaactacacgagataaggagcctggagaacattagttggctgcaggggtgaagacagacacaaaaagcacagcaggtaagagctgggggttgttgccaacaaggaactgtcccgggtggcgcagagaaaaggatctcagaactggagccctgtccctttgagtcttccatgcgtgctcaagcttgtcatcttccataagcttcgagagaagggacgttgtcagagcattccttatcggtgcgactaatcctgttatcagcttggttataaatatttaatgttccctggcctttcggtgatggtgccccatcagattcaaggctgttaagaatccccaccagcaacctcgcccctccctgcggaaaaccgatgagaggcagggccaagccgaagcgatggcggcctatccggagagctgcgtggacactacggtgctggacttcgtcgcagacctgtccctggcctccccgagacgccctctcctctgcgacttcgcacccggggtctccttgggggacccagcccttgcgctccgagagggaagacccaggaggatggcgcggtttgaagagggggacccagaagaagaggagtgcgaagtggaccagggggacggagaagaggaggaggaagaggagcgcggaagaggtgtctccctattaggccgccccaagaggaaaagggtgatcacctacgcccagcgccaggccgccaacatccgcgaaaggaagcggatgttcaacctcaacgaggcctttgaccagctgcggaggaaggtgcccacgtttgcttacgagaaaaggctgtcccggatcgagaccctccgcctggccatcgtctatatctccttcatgaccgagctcttggagagctgtgagaagaaggaaagcggctgagcctggtgtggagagtctgcccttcctcgtctggtagtgctggggtgtgtcaggaccgggcactgggtgaggctaaagggccgggagggaggccccaagacagaacgtctggtcttctggaggtcggggtcgagattgtaagatccccacatgcgctgagcagagtggctgctgtagagttcatatctacgcgaccgccctaagtgaagtcggggtcaggggcgagcggggaagtcagagagcgtgaggctgagtcggggccgttcaggctgctcctaagagcttccgtgggctgggtgggtgggaagtgaaccctcctcgcaaatggcagactttggagcttctataaaatctaacctctcttctttacattttttttttcatagagataataaagtagaaattcttacgtttttaaaaagcctgaagggtcggtggtacgccatccccagcaggcgctccagcgggcgcctgcgtggagggtctgaagcagacgccgcaagggtgcgggggtgcgagcttttctgctagccagagggttctgcctggtcctccgaggcttgtccaggaactgaggaaaggaaaaatggaaggcagagcagtcgagaggaactgctgacaaagtgcgacctctgagaagggacacccttcctgtcttccattccctctccctcccgtcccttcctctctcccgcgcgcaagccctctctcttcctttctccctccccttcgccacctagttgatcccagacggaccacagctccttgtcccagggccacagtggtgttcattcagtgccttagccagagtgcaaatctacgctttgcatctaaagtgcagcatcagcttccgtgttccagtgccttcttcaggccccaggccagagtaaggggcgagtgcactcgggtcactcctgggccgcagggggccttgggcgccctgcagcttcgccaccagccaccgctaccaactgtccccggccaggggttggggtatgaaggggcctggatctttctaggagcagggccgcctgagcgcgctcacttttacatttttagctgtaggtaggaaagatagctttcactctaatggcttctagagactaccaggggagacaaaaagtccaaagaggagatgccttctgacgccttgcaaaacgcctgccatgcagatgaggttgaagcgggtccatgctgagaggccgcctctagtttggacccgtgccattccaggattcttccttctaggtgacgtgctagtaccagaactggggtctttcagaaaggagtgggtaactgaggcgaggaacccgattgaataatgccaacctaaacataaattcagtaatcctaaaggataatccccagtgattattccaacactttatttcgcccctcattgcacacagaaataggcgggagcctgtgcgaacacacaattctcttaatcatgctttcggaaatagaattcatttcattaataagtaacatatactcatcctagaaattttggaaaaaaaaatttcaaaaaagagaaaattcgaatcactccacgttaccatactgttagcattttcatctatttctttccagtctttttttccctgtgcagttataaattcaatatattttactaattcgagatactttgggatactgatatttttccacttggcattatagaaggtgcaatgttttcccttaactttaatattattcaaatgtgattttgattaccatatcttattgtcttatccatgtatcacaccaccaccagccctttccagatagatagctatttcctttttaaaaaataaatgatgctgctaagagcattcttgtaaatgccttctctgtctattattacttcctaacatttgatacctagaagtgaaatttctggattcaagtttgtggatataaatggccagattcccttcttggtgggttctgccagttcactctcccaccctctagcattgcagggatttgcctgtttcccagccccttcattagtacttcgaatatttaaaacttttcttagttttccttttcataggacctggattagttctgaaacgagcccccactcccaagatgtttttttacttttactgtgtctttccaccaagaattttttcaactgcaccgtaagaacatcaggataaacaggtaaacaaaaaaaaaatacataaacagctaacaccaaacaacaacaaagccccatagagtgttgttttttcttattcttccaccaattcaatttctcctggaaattaaacatcattcttttttaaaaaatcatctgaaagtgttgaataaataaaaagaaaaaaaagtaattccaatctaggaattcttaatattttgctgaaagaacaagttttgaaaaccagaaataaagcaaaattgtgtagaccagggaccatcaacattcctaagtcgtgaggagtcagcacagccacccgttttcgttagtcttctccatcatattctaatacattttgttcctagaaagcaaataatattcctccagtgaatacctcttcatcatagtaaatgatacctaaaaaacttctaaattaaaagttattttcttattatcaacagaggaattatccacccttcttaaaaaaaaaaactttaatcgtttataaatgctttgctatttgtaagtttacatgtttaggaactgcctcaaatgtagtcttttaagatattttcataataattttactcagagtaatttgaacccaggtaaggatcagagtcacatagaaagggattgacattcctttcatcaaatgccaatagaggtaagacaaaatgatccacgtcctgaacttaaatcgagtatacctccatattttgaccctcaacttttctaagcattattttaattttagttttcctcatgttagatgcataaaatcagtgcacctttaacacaagttttttgtttgtttgtttgtttgagatggagtctcgctctgtcgccaggctggagtgcagtggtgcgatctcagctcactgcaacctccaactccctggttcaagcgattctcctgcctcagactcccaagtagctgggattacaggcacgcgcaaccacacccagctaatttttaatacaagggtttttgaatgtaacacccactacattaaaatagttttactgtttattatctcctaaactaccattgatagaaatatgagtagatattgccttttcagtaacttcagccaggctttttttaagacctaatggtgtcagttacttctggaaaattaaaataatttgtttttgaaatcttaaagtcatttgaacatttagaatctaaataccatctgagatgttgcttggaggtgatttatttatatactctctactgatggaacactgccttttggtctcaaactaagttccccatagctatcagattactattagtattcagacaagtaagccataaaaagatctaaatgaaatcatatttgaaagacataattaggctttctgaggaatctaaaaataatcagaagcccttaccatcaacagggagtcatttaggctgatcatcttttacagttagttgcccagcgttaaagcagattttggcaaaattaagtgctggaaactgaaccaaatattctgctagtatgcataattcctacatgcagacatatgatacaattaagacccttggattagtgtttattatcacatttgtcagcatttccattataaaataatcttttgggaggttgataacatagctgtaaaaatcctgagacgaaacttgataagcatgattttaggatacatttttttcttaattacagatcttcaaaggaaacttctaaagtaacgaagccacaagtacattttacatgtgcatttccaaaatatacctgatactttaaaaaaacaagagaatctatttaatacaaaatacaaattagactattattttatttttatcaaaaagagctagcagattagtattgaatgttaagtatgaacttgactttttataggatgatattatttcatgaaattaaattttaaatgtttttggaaaactggtgaagttggctatatatcattaacttggcacaagttcactcaaaggttcctgaactttgccaacattttgggtgaagttaggcccaatttctggtcagcaccctctcttcctgtgaatactggactaaaaaaagattacaaaacaagagtcagcagttctgaccattttgttttgactttggggtttctttgaatccaaagcttaaaaccaaacctggcggaggagaagaaggaaagaaaagaagcaatgcaaactgacaggaataaaataccagaaaggtggaaaaacttcctcaagtctctataaaccaaagcctataaattttcacaacattttctgtgacaccagattgtcagttctgtgtctataccacatttcttaaaggagtatgaggaaatgcaaagaaaaatatgaatgtgttttcaaacactcttcatggcaaatatgtggtagaatcccacccttaatctggcagaaggcatggaacattcgatatgctgtgaaataaagaatttgacaaatacgacacgatggaaatgattacaataaactgctttaggtttacttagtgctttattggtttcaaggcaccattcacatactttatctcacttgatcttcacaattggatttcagcaagttctagagtctctctattaaactgagtcatcagtgtagcatcttaaaaattccttcactcactattgaaatcagcaagatattgggactcccaaaaaggaccaatggtcacacataagcaccacagcactttgaaagatattgccttcaaagatcaaaagcaccttaacatgttctgtggatgataaattatacaaaaggctggtttggtctggctccctcaaaggccaaattttacaaccttctatttcaggctgtgtgaaggagatttccacctgcagccaacaaatgtagatgacctcaaagcagctgttatggacagttttttttatgatttccagtcttcaaaagagaagaaaaatgtctatgagaatttggaaatagatcaaacagttggtgaacaatagaagaaaaaacatcatctaaacgtgtttgaatgagtgaacgaatgaatgatagcactattactttactgcagataattttgtaacttcttcaaaagatagtaatacaaatctatatttggtactggctagatcttgaactgattggctatattgaataccagagttcagtgaaatattggagaaaccagaaagggtctcaaagagaacaacaaaataattggattattggatctgaatgaagtaatattatccataataagaagtagtaatatctgtaataatataacaactgtattgaaagcttatgacagcatgtgttctaaacactgtgttgagttctttatatgtactaaacactgtgttaaacttgtaaagttctcataaaaattttaggatatacacactattgttatttccatagtgatgaggacactaaagaatatggaagttaaataatttttccaagctcaatcagctaacaaatactgaagctaagatttccacccagacaaggatttcagagaccaaactctgagggattaagattaattggtgatgattatatgatcattatatttaagtagaaatattgtaaaaaatgaaaattgtccatcatctttgcatagtcttgtgaatctataattacttcaaaataaaatttaaaaattaaaataatcagataattactatgacaatcctttgaacctataaaacaccatagaaatataaattatcattagctttaatgagccattcccagatacttaacttatgtcttgttctactgtaatttttcttcacatgtttcatgaaagtgaaaccaacattttgtgcctggcattatgtggtttctggaagagaaatcgagacttgttttttcactctgacccaaaagaatatagacgagcactaagtgcttgactctgggttccttggtctgtgctgatattcttggtcagctacattctaaatatggatttgtagtatttgcacatcctaattctgttgcttgctaaattagattactaacttaaaacttaaacctactcatcctgatttgtaaagtggaaatcatgaacacaaaactatttaaagactcagaagagatcatataagtgctcatataagactcagaagagatcatataaatacagtgcctcacacaatataaaaatttagccaatgccgctattgttgtttacgttatttcaatgttgaatgtgtgtgtaggacaaaatgataattcagccttttagaaaggctcatgataacacacagaataggaatatgaaatacctgtcctgtttctcctaagtataatcaaagttttttaagtagtaagacattttgtgcccaatctaagttgctgccttgaactcttttatgtttttaaacatataaatttaaaggtaaggcttctggtccatggcatatgtaatcacaatcttcgatctgccaggaaggtcactgtaaagtctacactcctgaaatatcggccgggcatggtggctcaggcctgtaatcccagcactttcggaggcagaggcaggtagatcacctgacgtctggggttcaagaccatcttggccaacatggtgaaacaccatctctgctaaaaatacaaacattagccaggcccagtggagtaagcctgtagttccaactactcgggaggctgaggcaggagaatcacttgaaccggtgaggcagaggttgcagtgagccaagatggcgccattccactccaacctgggcaacagaacaagactccatcaaaaacaacaacaacaaccaaaaaaaactcttaaatttgcaaataaagctttttatatgaaaaagttaccacacgtttggcaaatcctccgggaatttactttcaagtaaataaactacctgatctaggctgatacgaaatctaaaaacctagaacccactcagcctgttcaactggaaatgaggtggtgtgccatgcttttttgtaggttccctgagacatatgcctctgtctacccaaaaaagggacgcttctccctgcctcccatagaaaggaatcagagaggaaaaaagaaagggcctcttcttggtgcatcagagaggcaatgtgagtcttgaagtggtctttggacatcctctgttgtatgtgccatttacacagtctttaaaaatttgtcacctaacctatcctctttatacaaacagattttttgttttttgcactttaacattagtggctttatacaatatcatggcaaaagctttgtattctttggcctagatttacctgcatctaagtaacagtttttgcaaagataaaattggccttcacttgtacataatctgtcaacatttaaaaatgcatagctctttttacatatgtagcatgttatataataaattttcctccttgcctagaaagttaaaaggagaattattaaatatcccatttcttttaaaagctttgattcaacttcaactggctcatttgagggttgatgggaaagagctttctgaaatgtactaaaatgtttccaatttgggaaacatacccaatttcaaatattctgaccatcgtttcatatttttggccaaaaaatgtggtgagtatagttaacaagcatttgacaagtagtggttttgttaattgtagatcttattgaacaagccaggccatttctttcatcactatttatttgcctaatctcaccaaagcccattgaaattaaagcatatgagttcagttaaaaaacatatattggatgccattttgtttcagatgacagaaccacaaagtaaacttcatacgctttattagtatactacattttatcaaattcagtcaactgcttctaaagttaacataaaacaggctgaaaagggcccaaactcaaagcattacataacaaaacacaacaacttcttcccaaattacacgcacacgaatatatgcatcatacttcaatccaaacctcagggtccttacactgaacaccctcagaacttctgcttctcaactccacaattcccctgctccctgctgattttatgattcacacacattcaaacatacctacgtgcaaaaccaaagtatttcaatcagagtgacttcgcgtgtattttagaatgaattttgcatatgtaaagtcttttttgtttgtttgttttttgctttttgtttttttttttttttttttgagacagagtctcactctgttgcccaggctggagtgcagtggcaagatctcagctcactgctacctgtgcctcccgggttcaaacgattctcccacctcagcctcccaagtagcttggattacaggcacctgccactacggcgagctaattttgtatttttagtacagaggaagtttcaccatgttggccagactgttctcaaactcctaacctcaagtgatccacccacctcggcctcccaaagtgctgggattacaggagtgagctactgcacctggcctgtaaattgtttttattcctagctcaaaccttaaaaaggattgacttttcttccttttcctccatgatttggtaggcagttttactcttttttcataatagatgtctctttcttgaataatttatgtcttaataataaggattattgaatatttctatctattgtaaccaaaacaggtatttaagtgagcatcagtatttttctatgcattgaaaacaagcccaggaattttgctagttcttcaccaaacattggccccacatatgtataccaggtctaaatttaactactaagaccaacagccagacaatggtagaaaagaaagtgtctggaattgctattctgaaaacctacagaacactcattgattagatgagggtcattgactcaatgagaaaaacagaattttccttgggattaagactgtttcttcttggggagattcaagagtatctgaagttcaaataatttaccgtatcaagaaaggagttagaagggattcaagaatgctctctgaaccttggctctgattgggaagatctaagtcatatctataacattatgaccttttgtgtattcttacaacttgcctacaaaaatttcacttgcaggaatttagcctaaggaaataatcaagaccatgcacaaagatggcactacaaagtatgcacctcagtattgtttataatatgaaaatatggaaaatagcctagatgtccaaaaaagtaagtccttaattaaaattgttccatccattaaaaggatgagttatcaaaaaagtttgtagtgcagaaagataattccaaaaattgatcagaaaaaagtattttataaagcagtgtgtaaggcataattttatttctgcttcatatgagaacatgtatatttgtgtatgtgcatatttttatatctataaatatacatgttcattttatttatgctagagggggactgatcattttttgtgcttgtttgtattttcctggtttgtaatcaggtcatccttttgtaatcagaaaaataataaagttattttaaactaaaaagagcaacacaacaatacaatttatgatatctactcttagttgaagagcaggatctagttatctaggtgagaactcttgtctttttaactctaaaacatttgaagtaggtatttaagatgtttagcagttatattgtataactttttttttggatgcttgggagtagaaccttcccagcacactacaggcccccttccaatcattgcccctctcttcttgcaagaatattcagtatcctgacttctaacagactagtttcccagtttttatattgttttacataaaagggatcattggttttgggaaaacattgattttcatttataaatctgtcttcaacaaaacatgtattctgacagccttccccaaaaaaggaagttaaaattaattagaaagataaggattaaatttaccattaaatactcagagtttaaaattttaaaggaaaaccatttaacaaacatgctctttcattctactgacacttaaatggaaaatttgattaaactttaagggatttcatctaaaacacagctcagtttatctataatttacatacccacaaacaccttccccaaaacaaacaggtaacaataatctatactaacactaaggcatttattgactagtcaggaatacacttaacatttctaatgaaattccagacttttaaacaattagtaaacagtttttcttcctacttagccccagtgtgtgtgtgtgtgtgtgtgtgttctgtgtgtgtgtgtgtgtgtgtgaaggtgcatataaattgtgtaaaatttaatatttactttctaaaagaatatattagaacctgataaatgtgacctccaagagcttttacaaattcatagtcacatgttcctatgcatattcattttaacatattttgcatattcatgttttgaaaactctgccacagaacaaaagaaaaaacatcaacttttctagcataatttcaaaatatttaaaatccgaactgcttttaataacttgtattgtttttaacatgtgacattttatccccattagtaataacagatgtctaatgcattaaaaaggaaaatcctgcacatgtgttgaaatagaggactttactgaaaggaaagcatgtgctttgatttatattagtcaaaatttagatactgtacttggcgctatttcaggaaatgaaaagctgaggaaacagttatataccagtaaaccagaacaaaaaatctcctcagaaaccaaaacagtttgccacttacgctaaattaatacctagaatatggtcatattagccccgagagagagctaattctaacaaaacaaaaccctatccattgattcatgtgaattatgttgtatttacaattattctttgctcacatttaattgtcaaaaattaatcagttaattacataatcagagattatgaaaacttgggtgaattctaaaaagaaaaaggtcacgaaaaacaagtgtttacttactgttctctgactccattatcttcactactggtgtaaaggtacacaaagggcaaattcaaaaataatgagccataaatccactattatttgtctggctggtttttgcatctgattttaaaggcaccttctctcctgcggactgttccagtgagctgttgccactcccactgcagctagtgcagagaaaggcacctcaaagccagggggcagagcaattaattcaagggacaactactgggcgccagctgtttacgtaagttatgccattcaaacctcacaaagacttactaaaaaggatattaatatatccaccttacacagagaaaaataaattcaaattggttaaaataccttgttcatgcagagacaaaggtggagccatattttgactcaattgttaccttctctagaggtaaatttgacaaatgttggtataatgaaagctccatgtccataacacttaggcataggtttgcatacaatctacaatccttgcaaatatggaccagaattgctggagtggccagcactttacaagcataaacagaaggactcctttacaaagttgctgttagctcctctgctttctatttatactacttttcaaatagtatatctgttgctactgagatgatttctacttcatacaatttgtatgatgtttccctactctcattttatatattagtactgcttcgtgttcacagagtgagaaagaaataattcctttaatctgagttgggctatttcttaagtgcttcagaaatacatctacgtttatgtgtgtctatatgtgtttgctatatatatatgtatatatagcaaacatatgtgtgtgtgtgtgtgtgtgtatatatatatatatatatatatatatatgcagcgtccccctgcctgtgctataataaaaagattattactgcaagaccatataacacttgttatttcctttaggtgatacattttattagagtacttcattattaataataaatatgataaatagggtactttagctgacaacataacattatcatattaatgcctggagcatgaatatgagagagaggaaaaaatatgactattagataaacccattctgtgttttaggccacgtctggcccactgcagtcaaatttgatatcaatacctttgtacaatttaattgagatgaatttctaaaggttaaatttgagcattataacaaagaacatttgtgtgaaatgtttgtttcattatctcaacaaaagagaaacacaacttctgagtgaaaaactaagattgttttatgtcatatgcagtgctagtataaaaaaaaattgctaagttatactgtcatacccaagaagcccaaatcaatgacaagagcagcactgaggtcagagatgctaaagagtcctggccgagaggacagtgtgaacaccacctaagtaaacaccttttaagaggaaaggacactactcagacaaacagtaattttcagtctaaggtcggggggacaccctttatggaggctcatataaaatgtattaccaaatggatcaagtgacaaaagtgaatacaattctcaaatttatggcatttaattcagaaatagaggttctcttgaaataaagttccaagcatggggagaatttccaagtcagatgatgtgatttataacattttcttcatcagcttgaagtataatgccattattacatctatgattttgcagatgttctttaagagtacttcactctttcataaatctaatatttttaatactctgactgatttgctacaatttagctgtagttgttttttaatgctcctatatcattagtaattggctttcaatgtattatactgtattaccattctactagttgttcatttatcattcatggcaaaagataagtagctatgaataataataacttttttaaaatcatagctctcttcctctctctctgtctctcccccctccctcttgtcttcagtcttttttcattttattgactacgtttcctatgctgccatataaaattaaaagtttcttttcaagattcttttcttctataaaaatgaatgaaaattatatgttttctacagaaattatatacaaagaaaacatgaagatatgttttatttcagcttaagaaagtcgttgggctacataaatgtctcctttgggaaagaggagttgacaaaatgatcaagaaggtgaacaatttcctgattcccctttcccaagtcaaatgttcatggtcattcttatgtgtagccctaaactaaacaagcatataaatgtcatagtgaggagagagtgaaaagcagaaataatgtaggctcagtttacatttaaattggacaggatcagattgagttttcttgctctgttcagcatccaattcttgtgctaactttcattaccaatttaataaaaatctatcaaatatttattggatgcttactgtgaacttggctctgctcaccacagttttctagtttggttaggagttcacagcagaatgagggacatgcacttggccaacttgagtagatatcggttgaggtatgtgggggaattagtaacatgagccactaggatgggatagaagaaatatagtcaacatattgtaaattctatactattttatatttaaatgcccataaattgagattgcaggggagagcagcattggcaggctaagtaaaatggtgtataactagcatgaagaatattaacagaattaaaagagtaaattctaacttttgagccaaatttaagccaaggatcatgcctacttccttctccacatgagaaagggcctgttttaattatctgacaatatttattctccccgtctttgtcagcaatagaacccgcagaggttatgctaaacatggccatccagccacgggtacatttcacagcctcacttgcagttagctacggccatgtgactaagatctagcaataggaaatgagcagaagtcacatatgtaatttttagatagttccccttaaaaaagcaaggggacatgtcttccccttgtttttctcctttcccattggctagaatgcaaaattgacatgagacctggagtggtctcttggtccatgaaattgaagacacattctgagaatggcagagcaagaagttaaatctccaacatggctgagccactgctacaccaagcctgtagcacctatccaaattttaaaataaataatcgccttgtttaagccactatactttgggatctctttgttatagtcccatatcctacctaatgtatctcttcatcccaggtgccttgaggtagtgcctgacacataataaggtctcatttaatactgtgaagcaccaaggaacagaatggttccaaaatacacacaagatttttaagcctatggctaggatacaaataggcaaagaccaagctgaaattcttatgagcatattaggctgacatgagagaggggatgctatacacaatgcgtttttcccactccagcttataacacataagctgttcctcaccccctcacttcatctcacaaggtactattctgatgtttcagaccagaaaatcaatctaactacataaaatgaaagagaacatgacatgtgatggaatagaacgcagctgtatacattatgaaatacaattcaaagttacgtttattccatgacagtaagaacagtataaatttaaatgcaataatgttttccaaagatatagtaaaatatatcttacctaaattcaaattttaaaattataagaaatgttgcctacttttatatcatgtctgatgtgactttctctctttgacaattcaattcaatactattagatttgaactaatagttcaactatttgaactatttgaactaatagtattgaattataccattagttctatactattgaattgtactattagttcaaatctaatagtattgaattatagatgatgatgatgattgaatggttaattattatgtccttacctccaatgagtggcaagaaagcattccagttaaacatgccttccatttaagattttgttgagttcagtgattctctcaaaagaatatcacctcactggtaacctagattatagcattttattatcaaatttcaggaagcacaatctcaaatcacttctcaacactttcaatgtatcagctaagaaagacaatatttacaaatgatgactagaagaatatatataactctagacactcaaaaatctatagcaagattaaaccacacaatcagaaagaattagcctttggtaaaaattacttggagtaaatcatttttgccactatatcataaacctatattaagtgacattattaaaaaaaaaaccaattctggccagatatggtcgttcacacttgtattcccagcattttgggaggctgaggtgagtgaaatgcttgagagtccagttcaagactagcctgggcaacatggcaagaccctgcctctgcaaaaaaaaaaaaaaaaaaaaaaagccagtattatgaaacttagtggatatttaatatgcatgtgttgtcaaggagtcaaggatactgtccttgatgatattcagtgtttatttctccatgaacttaagtgaataaactttttttcgggtcacaataccaggaatagttgggattcttctggacagtccatgtgtgtatgtacacatatttccttagaggccctatgaatcttgacaattgcttgtaaaagctgttcacattatttactagactttcttagagctagttgtctgacccaccactacaaaatacatgacattaaatatacattctgaggctaattcagctaagttttatattcttcatgttcttctcttcttgattaaattatctcacttgtctttaatgtgtcttcttgctgatttttttaaaattcatgtcatctatctcaagtctgtttctggaattaagtttatatttacaaatacatgaatacttttataacatatgcttcttgtttaagaatgtgttgtttctttttgtacttactcttgttgtctttgttttgtaacaattgactagatttaaatctctatgtttatttgtaccattgctcaccacggttcttggaagtgagattctcaataagtaaaaaaatacttgactttgtttttgtaagggaacaaaatggtatttccgtagtcctttcacacttcatatagtaaaacgcaatcttaggtgggtatatgaactgcctggacaacatccttttgacaatttttctttatggagaaaacctaaaaagcctgtttttattcctttatagataaatttttctctgcatgcttataggatggcttctttgtctttaatggtcaacatttctctgagaatatttatagatatgagtctactttcattaactttgctcagaatacaatgtgctattctactttataaactctggggttttttttcctactctggagaattttttctattatgtcttgcactattgcttcttctcaatttgtcttagtcttttcttaagaaaagtaattatctctgatttcacaaatattactgttgttaaaattatactttctccattaatccctacgtcccttccttgttttattttttttttcttcatagcagtattcaccatctttttcagtttcagtcctcatctcttcctcacacagacttactcccatagtgatctccaattacatagcttcaaatgctatccatactgattaattccaaattctatcctggagctcccaacccagagttctctcacaaacttgagatgcacatatccaactgcctgcccaacaattctacttgaatttttctagctgacaactcaaagtttacatatctaaaactgaactctctatctcccttgaagtgtgttgcattcacaaccttctccatctcagtggttgccaacataccctttattttgcatagatcaaaagacttagtgtcacccttcattcctctctctcacacctcatgtcttacctttaacgaatcctgttggctacttcaaaatatatttgcaatcttatcatttctttccaattccagttccactactaccactcaagttcaggtcacaatcccctgttatctagattattgcaatggcctcctaacttgtttctcttttcccccaaagaaaagcccatacatgccatagacactgacgagtttccaggtcagcactattcctgctgcacgagaatggtgtggtcaagtgaatactcatgagttctgagactgctgatggagtgacattgacatattatgaccagaatgcaccactccttaaatgtttgtaccatcctgagaaatcagaagaggatagaattgatgttttcctcagtcaaagaaaaactcctttcctattctaattactacagccactgattgggaactcccttggtattttctccctactattttattacacaaatctttggcttttgatactacacaagtgaaaggttcttctcctcttccagttcagggtcaactaatttaatttattctctgcaaagaacataaatcaaataatttacagatggtctctgctttattgtagttctttttacttctcatcaatacttgtactgtgtcacatccttctggttctatgatacaaaatacaaaattgtcccgattattcattattgtacttgggcaagcagggccagatatgttcactgggtaattccagaatccagaaagaaatattctctaaattaatatttctaaagaagtgtttttaatctctgattttaagtaacagatactacttggttttattatttttgtatattagctaaaatgcaggtttaaggtaacactgaggtaaactaagaaatacttaacctatggaagactgaacttcttgtaattctccaaagagaataataatcaatacacaagaatttatgaagtatctattttgcacattatggagtccgtgagtaatatgagaagggtctgtgttcttgtggcaattaggctacttgggaaaaaaatcctaacacaaatgaaacagactccagttatgagccactgtatgccaaattgtgccacagagaatcttagtgccacaaactctggcaatgtcatctctgttagttttgtgaactgtcctgcatgcaaaccaacttcctactattggtgaatgtccagtctgtcagtcttggtgggagactgctctcctctcataatcacttggatgaaggagatagtgggctaagaaaaacagaggaattgatgatagctcttaggcttttaggctaaacagataaacaatttaccaaaatttattgatttgcaggggtagaagcaataggttatgtgaaagtgacagtagtgagatgtctgtgagaatcccacattgtggtatcaagtagacagtttaatatgatagtctttacctcagcaaagatgtggcccagtatagaagctgaagaagtcatatgtgtcctgttaccattctttgacaggcagggcatagataaattataaaacttgcagttgatgtccccagtgtgcactttgtggcttcgggtggtaatagatggatatagaaatagttgctcttcaaacagaaatggctcatcaattaatttcctcatttaccctttaaagtgcaacttttgcattcagaattgagggtaaatgcttcatttcagtctacaaggtcttgcataacttagctctcagttaaaacaataatataaaacatgtaccaagtaccaggcaccatcttaaggggttagcacttaggaatttaatcatcacaacaacctaatgatgtacattattttctccctttcacaggaagcatggaggggtaagtaacttatctaaggttaaacaggtagtgagaagttgagccatatttgaacccaggctgactgcctctagaatccaggctacaatccactactctactctctacagccactctgccttgccagaaaaggaagagttgctctggacttctgaaacctcttctagttccagtattctacgattttattcaagtgcattttgtaagcagttcctccagtcctcaattgtgatgtgttaagaatttgacaataagttaaagttgaattagattcctttttgttctatttttattctgctttcattctatcaaattattccaacaatatgaacttctgctatacctagtaacccatgggaatgatacaagataaagcagttgtgattgctactgtactcacatgtaaaattgaataatctttctgctaaattttctcttaaaattctttctcttccatttaaaatatgtgttaaaatttctacaaaattaccatggaatattttaatgaatctctatttaaaatctgggtgcccaacattcatataagaatcaacataatgaaaataacactgaattaatgttacataaatctagaagaagagtttgttctttctcataattaaatcagattgtagtatattttagaggatgtcccagttaaaacaaaataagttaagtataattcatttatagtatctacttgctcatcagatagtccaagcctgctcatgttgttcagaattaatatctttgtctttttttttttattttttttttggggatggagtctcgctctgtcgcccaggctggagtgcagtggcacaatcttggctcactgcaatctctgcctccagggttcacaccattctcctgcctcagcctctcaaatagctgggtctacaggagcccgccaccaggcccggctaattttctgtatttttagtagagtcggtgtttcaccgtgttagccagggtggtctcgatctcctgacctcgtgatccacccacctcggcctcccaaagtgttaggattacaggtgtgagccgctgcgcccggccctttgtctttcttttaatttatacataactgttactttcttcctgtccaaaatttggctgtaaagttaaaattgcattaaggttgcttaagaccgttagtggatatttttgttttcccggtcttcattatatgcacttcatatttcctggaaatattcctactcttgatgacaactatgtctctacagcccattacagttaaaacaaagagcctatgcaatactttttgttactagctcacaactgagagtgaagtagaagagtatgtcttatttgatagacataattctaggtttcaagacctttcaattgacagaaatcaagacagtgagacaagaccaggcgggttctcatttcttcattttctcactatgctctatctatctagagctggtcccaaaagacagaactaacagtttcagccacgctgttcagtcccagccatgaacaagagcttctgccctgtgtctctccattcatcctccattcatgcttatccttaactttggacctcttaagcacagcatcagcagggaagattgatatagggaaatagaaaaaaaacctaggataggttaacatcatatacaacaggatctggggagcatggtccttcctgcctgtttgcaacctatcccagtatattaaactaggctatagattttccttttttttttttgctgtatgtttcagattgactcaataaacgatgtgacatgtcatctgtatcttaatttggtctgtgagcctttctgtgcctttctgtctgggatagctatagcattcctggccaccaccatggcattaaggtaattctccaatgcacaaaggcactcatcacctcagtccaggtttgatgtccttccttggcattctgtgcacacatatatcataatatttatctccctatgttacaaaattattttcatattttgtttcccaaaatactgttacatatttgtcagggactaaaccttcttactcagagaacccaagagacattgacacatttctgttaaattaccaaagaatcaataaatccattgcagttaattagtgccagttgaaaccagatttcagatctcccaaatgcaccattaggcagaaccagaaccttacaatgtctcaaggtcttgaatagagtgagtgagaacaagaatcgtcatttgcattgcttttactaaggtatctgtggtgggaagggcaaagacattgaccctagcgaaccactaggaaaaatacagtctgacttctaatgtgcaggtcaaatggaaaataatatcatgtccagggaaaaatgatgacatctgtcttcccccggatgagatccaccctaagatccagtaatgacaatatattgccatctttactctaatttggcacagagctcacccattagatgaacaccaaccttaattataaattgaatggctctccacctgtctcaactttgttatgacttgggcaacaattacagaaattttcgaatctaaatgtctgtaccaagggacaggcagtgtctttgatcagaaacagagacaaataatcctggagcttttatatttctctcaaatgcatcaatttctttctcttgttatttaggccttttattcctcctatatataaagtctcattctcttgttctctatcactcttgtccacttgttccagctctctcgttcaccttctctctccagattctgatctatctcttgacctccttatttttcttattttctcttactctttctgctttctttcctttttttttttttttttcagagtctttggtctactgctcactcactccagcagggtctcagagagagtaattagggatatatctgcataaagatacaaacgcaaagcaaaacatttagttccaaggaaagcaggattccacagcctgatcatggtagcaatccaccagaaccatgaaagtcttcagaaaagtatcaagctataatccaatttaatgtacaaagtaatcaaatattctaaaatgtttttgaaagaaggtactagaaaagaggaaggatctctaaaatcagagattgtgtataataattctgaggaagtgctgagagtcagtaccttaagatatcgcattttttccatgtatctgcaaaataatttattatcctaaaatttgcattaaaatataagtggaaaactataaaacatagttttcatatagttttcaatgtaaagacaacccaaatgcctgaagtagaaattcaaactgttaatggcattttgaaaaatcttttagaaaaaaaaaataaactgtttttcattgccaaacatggaattaagtaaaattcaaagtcaccaagagttttctacaaaattatgtcaacgtaaaataaacattttcccttaactacattagtatatttagtatattttctttatgttctaagaaagtacaaattataaaatcttcaaaagtttgaatgctaactcatgtttttttaattaataaaaatggcataaatcaaatagacatctccaaatgatattcattaattgtgtgttatttttgctgttttgttagctttcctcttctctgagcttctttctaaacaaagttatctgggaaattgtgtcctcttgtggtgactggcaaaaacaacatgttttctgcagaaagaaccaaaccaaacaatagcagcaggacataaggcttcaggaaaacccatttgtgaaaaacggaaatcccttccagtgaagaaaggtgaaagttatgagtaatcagaaagagaaattgaattgaaaaaacatagaatgtaaatcattccatttatatttaaattactggtcatcggatgattaaaaagaagacacataatgctatgtagaaagactgagaccatgataatagttcctatgaataactatttatttcttgcattctttcatcagttattccagcaactctttgatacaagtgaagtgagtgtgttttccaacaaggttaatgggcagctaagacaccaactctccagcctgcacaacccctgaaaaaaaaaatgaaaaaaaaaaatgctcttcaagactccatacttttccatattctgatcctgcactttctacaggttagacctatgtctcctcatcccatccttaagctgagttcagaatgtcagctattttaaagattaacatttatttgaaaatttcacttgcggtactgttcgcaccctaatttattgtgttttttactttttcgttttatttctggattgaaaacttcacattttataactttagtttgttttttttacttttaaagatattcagatagaaaaatgtagaatcagttgagtttatgaatcaaatcatcatttaaagagaaagagaatgagtttttatatagggaaaggtgttcaaacatcattaaggctaccagggtcatgaaagaagaataagcttttacacagttattgtgttgacatacatgactttatattccaccttactaaaattctctcatttaaacagcagtccctctggagtgttcaaagcaagatgaaatctaagatatacaacctcatctgatattcactcaattgcagcctttctaattttcactcccttccgtgcgaatgctcctgtgcactatttatgcaattcagataaattatttctcagaactcggagccaacaaacaggtgataggccatctaaggtctgaggagaaagaagagtaggaacagattgaggtactcaccttttatgcaagcccaaactccagaatttaccagttggctaaccattctatagtgtgtgtttcttttccgtatctaaaagtatttataattggttgttgctaagagaatgtcacagcatattcaaactgccaggatacttaatacttattgtatatgttcaatgtgagatttctaactctgttacttttaacagtattttttgtttcaatttttaacacagcacacattcctcaggcaggattgcaaacatgccaagtttgcagtttgaaaacaaagatcgttttgaactatccaagtacaaaagaaattttttttttcagttaaatttttttggggaggactttactttagaaggaggcaaaatgactgaattccagttaatctagcattcccaaagaaggtagtccccactgacatacttccagttaggctaacttcagcctcaaaagaaaatttctaagattgttttcatgatctcaagattgggattttagaaagaagctttcaaatttaaactaaacattgcagaagttgcaattattgttgcatatataagagaatccagaattatacctgacctgtcaacaagtaaaaagggagccatccttgcaaatgtggaaaagaaaattgttaggtaaaatgttagataagaaagagctgtatatgagcagactggactcgtcagccagggcgtgttgcagtttgcaaagcagggagtatctagctccagccattttttgagaggtacctcctggactacttttgctccaaaagtaacattcaagccccacttaagaactcaaaagtcgtctcatcctccactccccggaacagttcaagagccatttcttcttagaactagtcatcaattgtgactgtggctgaaagagtccatgggcaggatggttctggttaggtgttcattttgaattcccctctcagtattctggcatcagagcgtcgcctgagccttgcggggatccctgtacccaatggccaggagctcttcatcagctagaagtttagtgccgggaaaagggctgggctcacttgtttaagaaccagtctttgagactgatgactttgcaagatggactggctaatgacccctggctgctgcgctgctgtggacttggtttctcctctagcttgtccgctcccctccccttcccaaattccccttggtcaggtaagatttcctttacactttacccacactttcctgtcttacttatccgtggccacaaaggaaagagtccaatcattcgatctctttatttatttttgagaaaagagaaaaaaagaacaaaacaaaaataagatttatctttaaaaaaatagctgaagtggaaaaggtttcgagatttctgcagccacgttctaaataagaattgcagaatactgtaaattcagatttacaaaaagaacacttggtggagagtggggcagaatttctgccgcattctctaagcgcttccaagagataaaatcctgtagcggaagatgcaaacgcaagggtgcaggggtgactgttttgagaactgctagagtgctactgaaattaagtggaggtcaagtcgaatctgattttcagacaattttacagtaaggcagcggctcactaaacaggccagttgacaagctgtagtcactttctgagtatttctgtaaaaatggtaagggatcaactctgcaatttgtccctcccatgaaagcacagtcttgtttacacctcgctggagaaataacactcgccctcacttctcccaaaaagctgaacccttcagtcggcccaagcagctccacaccctgaggtttccaagaccaaagctgcgagtctcagcagggaacagccacgtggcctgcctgcgcctcgcctgggctcttgccttcagcttgagatatctgcagccgcgaaccttgctccagcccagaaaggggcgctttgctcaattaattgttcccgccggcgagtccgtactgagaagcccatgagcggaccttatgtgcagggtactccagcgcggtgcacaaaactcgtcgcccccaaacgctgcccccaccccaacactgtgtactgactccagctttttactttgccatgtaagggatggacctgaaacggttattttacctcaattcatttcaaaaaggaaacaagtatggcattgcaaaagatgggcttcttatccaaggcgacttcctttctggttcaccaactttgctgcttccagtttgccaggatctacattaacaccctctttggggctcttcgttttaacttacagacagaaatgcttaaaatgttagcgtatccaagcatttggaattggggctcacgaagcctaattgtccactggatgccctagatagtgggggctggggcggggggggtctcagagcgggcagcccctatgtctaggcgctatcaaattcccacttcactctcttacaagctggcctttcaaggtcacaatgcggagcctaatttgggggtggggatgaaatggccacagggtctctcccttgggttggcattgccagctgttagggccgcagcaaaggcgctgcgctgcccccctctggctctgctgcctttcccatggactgggtttccttccaccgaagagtgaacttctgcctctttcgagcaccttccgaggcgtagtcctttggatgttggggagcgtcagactgggtcgttgtagaggggaaaggagggcccagaagggcgagagagcaggccgggacgcaaatcctcagcccccgcggcgcggccacgtcttcagaaacgcccaggacctccgggctgggccgccgcggtttggcctttggaactccaaggggttcgtctacctgaccattgggtgggctccgcggttgacacttttcttggcatgcccccccaccccgcgccacaccacccccccagccccagcaatcccaaatcggccccacggacctagagggctcttgggcgagatgagacatcacccactgtgtagaagctgttgccattgctgctgtcacagccactccggatggggctgccaccgcggccaggacagtctcctccgaccgcttcctgggctgcgctagggttcgggggcgctgcccgcacgctccggcggggaaggaaatcgccccgcgcccgccggaggaaggcgacggggagggaagggggagggcggctaggaggcgggtggaggggccggccgcccgggccaggtcgtttttgaatggtttgggaggacgaattgttagaccccgaggaagggaggtgggacgggggagggggactggaaagcggaaactttcctataaaacttcgaaaagtccctcctcctcacgtcaggccaatgacactgctgcccccaaactttccgcctgcacggaggtataagagcctccaagtctgcagctctcgcccaactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctaggtaaggaccgcgccgctgcaccccttcgcctctcaggtggcagacggcaggccggccaggccgcggttcccagtccacctcgatttcctcccctctcccactctccgctcagccttcccacctcacttggcaccgttgcctcgcgcccccagcgtccccggaaggccggtctgaccccgctagggagagcagtctccagggggatgcgccctggtgaggggtgtgtgtgcgcgtgagtgtgcgtgacaggaggggagacagagacacccagggtcacgggtaaggaccgttttgtcagcgccaccctttctttcggctttcaatttttgttctccttaaaacaaatgttttaaaacaaattccacctcctcctcctttccacccacccacttcctcttgcccttgggctgaaatccttccaggttgttcagcttaatttctcagtggtggtgataagaacagtgctcactagtcttagaaaacagccgcagagacctaaacaataaccgactcccccccccccctctgggtttttgcagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaaccttagagtttggtctatatttttaaaactaaagattaagttggtggtaaatacctgcttgtttaattctagaggcacccaggagggagggggcactaatataaacaaagcaatgaaaaactcaaataaagcagctactgacaggcacaagcatgttattttaaaagacagctttattattattccagtttggtattcagagggcttagtagcatctcttcatctcttactgtctccaaacagcaaaaacttaacaaatttgctattcacctcctttttattttgaggtgatagttgttaaaacagttaaatgcaaataaggagtataaaacctgcactattctcttattatgtactttttgtcatgctcttcactctttgtgaagattcctaaataacaggttcttttcagtgaaaacatatatagtgttatgaaaattatctatacacatatagaaatgaccagaaatgcatagaaaataaagtgtaaatcagcagaaaagagaaaattccatttgtaatttgcttaactcttctctcatgaatgaatatgacgtttagtgtcatgtttgctaaaaagaaaagttaatatatcgctatattgacgctatttgggaagcatcattctttttttatgtgtaaagaatataaggctgtggaataatatacaaaaatgaagatcctgaactttcagtatccttggtaactggatataatcacagttggaataatcacagttttaaatactacagctatgcagttactagtcagttcattagcgttatattttatccagaattacacagaatttttccctggtgagatcatacatacacacacacacaatctgaagttaagtaaaacaataatgggcaaacgggggtgtttgattttttatttcattctgattatttgtgggccaggaacatactggcttttataattaacattattagaaatagtgattttgtatcagttcttagcttttacatccgatttactgcatccaagtgtaactggggaagctttcaaactggaaaatcattttggtgcctgtttcaaacaatgactaataagtgtatgtatccaaacagatcgtttttgcttagctcaggtcaaagttattttattgcctgaaggtttttgttttcttcttcacacagcaccatagaatgctgacataagaatattatgaatttattgttaatatttcagactatattttacaataaggagtctgcagcattgacttgtattaaaaggttagtgaaagcttggagaagtattattatttttttattttgatagtcctttagcaaataacagaaagggaaggcgattatgtgttggtgtatttgttgggggtgtgtgtgtgttgtgtgtaaggcaggttagaaatgtaaggagggtgccctaggaggatgagggaaagcattaggttggtaattcttttttgtatgtatcatccaaccacctccattttctaaattattcatggggagtctccttgttcactagcttggtctgactatttgatatttcagatttcttaaggtacaccaggatggagctggccatgactgctgagaaggtaattgttatcttaactctggatataagaactagatgtgtcaaagaaaggtagctctccatttgcctttcttttatttctttctttttttaatgtgttttgctttttctacttttttcataaggggaaacactttggagaaaagcaaatgccatatttatagtaatattaaatactaatctgaaggtaatgtttccccccagattttcagagaaataaatgaatgaaaaaggtggtaattttattttgaatgaggcgactgcacaatgaaaaatattaactactggaatgcagtttccagcttgcagattctaatccctacccctgtatacacaagacataaatcgtgaaattcttttttagaatagaaatgaagccacctgtttcttttcctccaccattatatcttcttttgattttatgttatttcattttatttttgctacctacccttatttaaagaacacatagaatgaattacctcttgttttcggaaataagaagctaaggctttccaattaatgtgttggttcacttgggatctttttccttcagaatgcatttgctaggggaaagtattgtattaaattgtcttgggtaaattgtagaaaatttaatgtttcctttactgtgctattgattacttttatttataagttggtcagattgatagcctttagttataagaaagcagtaatttttttacccatatgcacatttccccttttgttcacagaagcacatgtccagatgataattcacgcacagttacaggttcccctccccaaagtggaacgtattattaataaaataatgttaaggagcagaaacttgcacgatgtgtgtaaattttttcccacactcaacaacggcacaagcttcttgacccttcggtcttaaggttcatattcataatggagctttttaagggacatttggcctcttgcaaaaaagtagagcattttgcacattccatggtttggcaaagtcagaactggttattttctctagaccggtatcaagttcttctcaggcatatgatttcacttgaagtcctgcccaggaatccttcaaagtgagcgtttgtcccgctctcatgatgtcaggcggttttccctgcatctgtaatttgaagaaaaataaacaaacctgcggggaacaaacgccacggaaacccaaacagaactccgtggggagcgagggtctcacctgcggcaggcgcgggagaggggcacgggcacggtctcccctgcgtgggtggcgggcccggctcgcgcggtggggagaatgacgatgtccgtatctccttcggtttgcgtggaaggcccccagccccgcgtctggccgctgctaggaggcggcggtgccaagtgtcagcggtagcaaggggagcaatagcaacagattcaggcaaaggcccaacctcgaatttccggagacaggcccacattagcgacagacaggggtcgggcggggatccccgggggccacttttgcagaattttccgcttatatgtcgtaaagagtgcgccgcccccagcaccagtgaaagtggaaggaaagtgcactggcaaagtggaaggagaaatcggtttcttcatattttctcaaagccggcaatcccactatttctcagaaaccttccaactctttgagagcccacgaatgtgcaaataggaggattattaactatctttatttactggacagcaaaggatagacccagtttaaattaaaaaaaaaaaaaaaacgacatgggatacattttccattttcccctcgcttttgtctcaaggcctaaggacgtgagcccacttaatgttcttagcaaatcaaagcacgtgtcctttgaagaaggtgtgtaattggagtttaaggcatgtatggaattcccagatgtctataaagtaagaaggagcatgtggcaggtcactggaaggtggagcaggttaaaatcactggcacagaggagccccctttagattctccttctttgtaaggaccaacgagataagccttctgaaaggttgggatgggatcatgatgaatattcagcttctggaatcagagtcatagtaaccatggtaaaaagcacatggtcagaaaacctcaaagaaaacactcaattatagccgggattttgtgggcgccctgcaacgagatcgtttggggtttgctgcagggagagcctgcaacagcctcctttcttgtttacgtggactcttttcttttccttctattttttttttctctcacccgctctcaagtttgtggatgtgtcctcctccttcgtgcgatttaggctgaagtcagaggaacaaaattctagattaggaaaagaaaaaacaactctaaaagcattcattccagaaggcagccttcttgggggaggggagatttccagcaagtgaaattaagtttctgtaaaacatgaagtttgcgtatctaccagagagggaaatctcacgaaatgactaccaccaaaatcagctgctcttttatttcactttattgaggaatatatagatgtataagggactatcgaacctaagtgtgagtttgtatggagtagtcggcagttttccttttggtttggttttggtctgaagacagaatcgaaatatgactttttttctggggttcaaaatgctaccctcatttacctgcacagtcaggcctgaagtgggagactaaggatcgggagtctctcaaagaacctggccacggcaaaggttggcactgggagggggtgatattgtgggaagctggaactggggccagcgacatgggggtgggaggtgggaggactggaacaaagtgcacccccacagaggccaccactgaggcaggcgggagagagaaagggatgccttggggggtgatgtgagtgtgacaagtgaaaagttaagcaggtacctgaaggaagtttatcttgcccagatgttagggcttttatgaaatgtcacgtgaaaggaacagacgtacaacttgcaaatggggacacgcctgtaaatacaaggaaggcaaatgcttggagagaaatccaggcataaatcatcaacctccttttctagatatctattttcttctttaaacatttgctttcagaaagggaagacacatctcaagttgttaagtgcatcttccagaagtcacaattccatctcctgcccaaaatgcgcatcccctaggttcctttggagagttagggtgagagatgaatttcaccatccccctcctgttttccttcttcacattccccacttcccacattgctctctggacttctcaaagacgtttgatcctgaaaaacatatcggatctcggtttggaaaagctgaaactaatcaattgcctttttgaaggggtagagagtgataagaagagcgaaggaatgccaggcctgacagattctaaacctccaagatgcttggatgggctgaaagatgagcgggtgatcccttactcatggggccaggacccagcactctgaaatccccgagcccatgcggaagggcttttaccaagatacatgatcagtttgattgaaaaggatttttaaaaatgacttgtaaacagaggaagcattttttttatgcaagaagaaagcttgtaaacaaaattaaaacgaattagcagttcgccagatgtggaagagagtccaattactttctccatgttgaataggaatgttcttagaggttactgtgaatgctaacatgtggctcaggccagggtcttggcatacaataaggttttaaatatttgttacccatatattaagacgatatattcaatgaactgtgctgtggctcttcttttagatgcaacactatccctaaatctctgttaaattgacattatatctggcttatgttattatatagccacccatatagctctctactttaaacaaaatttaaaagtcagggtattttcttccacaatattaaatccaattttactgtgagggtttatcttattcctttttgggcttcctacaggcataatcagaaatgaaatatagtcagtgatcatattagctttaaggattgacaatttttaaaatttccagaccagataaacaggctctttctctctatagcatttaatctcaatacccatccagtcattcctagccttgatttattgttacctttgggtgcatatcatattatttggttgtagctcacagaggtcctggtcactgaggagcatcagatcctgcctctctaggttttcccgtccttgtagaaatactcggtcaaaccccaacacccagatttggctgtgcgaagctctcctttgggactgctatgcctccattttctaaacatagtactggacaaaaacagcccacatttctcttcttttgttcctgaaacttaacaccaatcaaagaattgttactattattgaaagcaaacttgaagcagaaaccatcttcctaccacaaatttagcaatgacaaacaagtccttcagagaggtctgtggatgcacccctaatggagtcagcactccattcctggggaagaatcctgacatccagagcaatatttacaaagtgttcttataaatctcgtttgcacattatgatggaggaaatttctattagcttcttgctaaggttgccttttgcctcattccgccactgacttctctccctacccttcatcaacgcacaccttttgaaacttctaactttgtaacctagagactcccttcttcctcttccttctctccccgccgtactacgtgaaacttaaaacacatctcatagatcagttttccttctctgatgttaggcacagtccacgacccggattttcaaatagcccaggctggagtctgcaacatttaatccaatcagctattaaatgtcctctggctaaatcaagagtataagaaagaatccatagcgggataatgataccaagagcagtttggtggagggaaaggaggctaggagggggcagataactccagggatcctttgattggaaaaatcctgtttttagaactcctgtcagagtaacaacaaagcaaagaaacatgaaagaacaactctttgttccaggatatggttttaatgaaatactactaacacacacacacacacacacacacacacacacacacacacacccctactattaataaccgcttcagagactccgctttcctttacctattagggactaggaggctctgtaacgtgatcctctcccctctccccctttccagctgcctccttccctccccaattaagccaaagtggttgttctgatgagccccggcccgcacagaaccgcaggctgaggcttcccccggtgtactggctccctaccccagcacgagccttttctgggcagagccaggcccatgggacttggctgtgaggacctcatcttctagtttccgaaggcaggcaacccccaccttaagagcaagctcttctggtctccggctaggggccttcttaagaccctaacaaatgtggcatcaggaggatggcgtgcccaaagtatgcctgccttggcttcctactgaccctgctctgcgcttttttgttgacttaaccacccagagggattgcaactaagacagcaaacggggttgggggtagggaaggagaacgaagaagcagggggtggggaccgccagagaaaaagcaacagcatttgggaagggggggagcaaccttttaggcagcggggaccaggcattttagcagccgcatctgtcatctgtagcagtggacagataaaaccgtccctgatcaaagagattcgttcataaatcacccgtaagaaatggattgtgaggaataaaagacacgtgtcgaataatctcgaccctggagtctgctcgccgccagcgcggttcccagcgccccctctttccataaacgcgctgcgagcgagctcgtgtcccagctgggaatgtctgtgggggaaggactcttctttccgatcctctctgccccccattcctgccattccccggcctcggtttcagaagccgactgggccaatccctgttcgggatttcaggagatttcaatacaatcggttgattctgagttgaccaaggaaagagcaggagggaagttggcgtgttttctgaggcgacaaagttgctctcttgggatcgaggatatctgccctccaggtcccctcttaatgttctcgtcgccctaacgatctttcctccgagaggactcggacatttacaaagagttgctgtgcaaacgtaacgcaggcgggagagttcagcgagagctaaaattggctgggcgggagttttctgttccgggttttgcaagtttcgaaggaacagcggtttgcaatcaggtttccgtcctggagtaatatctaaggagcgactgttgttctctacacgaggacctagtggattctctttccccgccttccacctcctaagccccagactctcgcacctgcttctcctggtcgaaaaaaaaacaggcaaaggcgaaggtcccgtcccgtgtgctaaaagccccggccagctgttccgaggactccagaaaagcgtattgggtttagaagcgctgtagcctgtctccaagaaggtagttgacaatgctaagaaaaattttgagatttgtataggaaatttacagcgaaaagtgccccttaccccttactttactctcagttttggcatcctccagataagtaggattttgcatataataggtgtttatggttccaggaactgcactttgatctaggattttgggggtggagtgtctaaagggtctctagacgcttgtctgatttgaatgcttttcaggatgatttatggcaaaaggctcatttctgacacttccagatgtcaaagctcttaccttccaagaagggatgagggaaacttgcttcccatagccatgaggatgggagcccgcgcgcctaatacgcctgcctgccggtcttcctaaactgaccctgcctacgggcgtccatctggagccgctgataacctttccccgccttccagctcaggagaggggagggacttgctttttatgacggcaaagctacagagggaaactaagtcactcgcctgcaaaacgaggttttttctgtaactttattttgtgcagttaaccacctgctccctgccccgttggtggtttggctttaatgcgatttgacccccagatgtgaagctgggcagaataaaccctccgttgggtccctggtggtgtcagcctccggcctcaacctctagccgccgaggaacggatcgcaatcctggttcccgcggggcggagacccgcgcagcgttcagaagctgccggggactcagggggagggggcgatgtctttccgaaagctccctgcaggctcaggaccgcgaggtgaggccaggaaaaataaccctcgcgactcaattactgcgagctccaccgtgaagctgaaaagctgaaatgtgcgccgcggcaggggggcaggtcagacagggcggacgctcgggcgattttaggggacccatagggccagctgagctgagaacgcgctgaaggcagttgtcaacctgaagctaaaggtggggcagaccctcagtagctgccgcggacgcgtttctcaaaggaaacggggttttccagttctttctcctcctttgaaatgtaatagattgggaacggggaatggggggattttgttttcttttttctttctcaaagtgaaggcaaattaaggaaggaattggctgcggagacttggagagcagctgttaggagggtctagtccagggcattgcttatacaggaaggtgtaccccggagtgatattctggttatttgcttagaatcctataagacaggaaatctgtaatatttggggaacagtatctgactgtttcagtcttttctgatgaggttacagactcccttctcttttcaagtcctgtagatgttagtaacttgaaggtcagccgtttgccttcccagttgaaaaataagtgcgatttcccaggtgaaataaattaattaattcgagaccctttaaacaaatttattttccaatgcacaagttttcctcattctttataatgttacaaaacaaggaaccagatcagagcttattggtgtgtgtagaaccgatcctgatttgataagcttaatcatatgacaaaggtctactaattattccctcctctctctcaaaagacacccagaaaggtttttgaaagtctctgcctttttcctaaagtttgattactacttcaaaagactcaggtcacctcttgccttttctgtatgtacatcttcaagagcataaaaatattaaataaaaaaaactttcccaacttcaaacctatcaaatgtttaacagctgaaggatatcatctttaggaggcaggccaaaatgtcaataaaaaatttaattgtttctgaaacatatgtgagcacttacaagacccaaaatgtgatactaagtattgatattaagaggaaaccttacaatatactttcatatttgctggtcaagaccttatacccccaaaatgttccagaaaccacagaaatttttattcttcctgacagggtttctaaaactagcttgagcaacaggttggtggccaaaggggtcacctgtattttgtgtaaggagaaattagtgttgaacttctatatctttgtcacttgttttctgtataaaactgtgatatctgtagtagcaaataatatttcattgtggaatggggagatggtatacattggtgtggccatttttgttaacagcaaacaccgactgccttccaaaatgtttcttccaagtattcttcctgacctattgggaagtgacactggtagtgttatttccatagttggctgtgacaaacaagaatgatatgtgacctaaaatgaactccaaaatataggtagagtcttctggtagccacttcttctattcataagctacagtttcgtttttacatgtagcttccagaagacgtttgattttataaatatgccactcaaacttcaactgttgaatttcaggttagttggccggtcaggtcaggtactgctttgggaccgttcttctgataaactctgacaaccggtttgactttattgtcgttatttccgattttcactgaggttgtcttcacaaggctttcagaagttgctttggctgcctctttctccctcctaagacaagtggtttccaatgccaactttcacctgatggtgatttccataccttctttgtttggttattaataggcctccaacattggaataaaatttctatttctcctagtgtttagattcatttaatttaactatttaatttacatgaaggactcgaagcccaatatgtttgagacatttgcccaagaataatttggcctagtctagcattcttttctctacttggaaccatgatttttgtactttaagtacgatagtaaaatctaaaattggcctgggtaccagaactactcattttcttcagctgaacaaggattccccaaggctcagtatcattttcttttactgcaaagttttagataaacaaagcagataacaagaacacgactgtctcttaaataatgagactggacactactctatgtatagacttaacacctggtaagttgtaaaggccaagttataggaataagaattactatttggctattatatcattttgcttcctgactgaaaataagtgtctttatttaaattaaaaattctaatagtagtattttgaatacatgtaactttctaaatacttctgatttcattttgatttttaccatttctgatacaaagccttgcttgtggaaaaatgccctgagaccgttatttttgccttttataaggataattaccactaacaatactcatatgaattcaagactgatggaaaaggaaagataattttttttttttttttttttttttttttttttttgagacggagtctcgctctgtcgtccaggctggagtgcagtggcgcgatctcggctcactgcaagctctgcctcccgggttcacgccattctcctgcctcagcgtccctaatagctgggactacaggcgcccgccaccacacctggctaattttttgtatttttagtagagatggggtttcaccgtgttagccaggatggtcttgatctcctgacctcgtgatctgcccacctcggcctcccaaagtgctgggattacaggcgtgagccaccgtgcccggccggaaagataatttaactagcctgtgcagaactgtttgttggtcagaaaaaccaggagtgcagtttgccccatggagtgattacagatgaggcagaaccaaaggagagtgatcatgagtggtttttcctactctgtgcagatgatcccagaggtcttttcaatctgtgatctgtggtgccattcttatatctgacatgctctcctagtgggttttcatgagttattgatgtaaagaacaacctgtaaccagagtgtaggtagcacaattcataaatataacaacctacgtaaaaagtatgtggacttacacaaacgtacagccacaggtgactctcatttattcctgtaaatcatgtactcagttatctggctgtacaaatagagttaaaattgtagatcagcaagaagtaatgtcgaaatgttcattcttcctcaagcacttttcttcaagtgacaggctgcatggctggccactatgacactgccttcagttgaacaaatgaaagattattcagtcagcaaacatttcttggagttctgattacgatctaaggactatgcataagtgaccatgttatgctcatgacagtgaaggaagaagcctctaatcgcagaagcatggtctcacttgtgtatgtttagctacatgtgcactggaggtccttgcggtggctaccacaccccagttttctttgatattttgaggtggtgcagaaaattagagaccccttacctgtgggagaataggagtggagagggaaaataagttcctctgcattaagcattctgagagtataaactttagaacagaactaatggaagtgagcccaagaactttctcttttgcatttgctattttatcttttcatcaatctgtaggaaaaattaagtgattagtagtcacttattagactatatgtttttggtatacagatgcctgtccagcttagtgatgtgtaattctaacactttgctttgtgcctggcacatgacatttttgttaatttgaactaaatatactaattatcaacattataccaataggaaaacctgggcagaaatgactgaaaaatgacaatactgacagtcccattctatcatgggcaggggggcggggtaggaggattaatactcttatctttcatttttagaataaaagcccaggtaagcaaaaagatgttcaaaaacatttattgaaacattatgattcagacacttattttaaatgttttaaatttaaaatagctgtggagcccatagttgctatttgcttatatgagctccctgtctaaatagtaaagggagccctttttttcagggcttatatcttattgtgcagagtgggacttatttcaggcccctttgcactgtggaccaagtgcccttgttcagtgaccatccctcacaaccatatgtggcagccatagtattctgaaagtaataagtattaagtctaataagaaatttggctagcatattagtgtgttgtaatgtctgtgaaatcaactccatttgtttcgtgtgagagctccacatatactgtccacatgtgattcttgtccaaactggagcagcctgtccagaagggtctgtcttttctcctgattcggccaattagggctctattttcatatattcctgtgcaataaacagctccacattgttctttcaccttctaaaacagcataatcactgatgattaaacagtacatgccaatcagtatctgctgagaaactgaaacttcaagttacttttttactgcacatatccacacattattccaaacccaagagtggtggtttagagactcaaatgtaattgattgtgaattgaaaagaggcattctaaaaagattttaccatttgtgtgattagtatgaatggagaaagttgcttctccacccccattcttctcctgccttccccttcactccagggatgcggtgaacttgtgtaatttaaggcaggtggtccacatagtaggctgaccacagaggatgaaagagtgtgcatttgataccctgactgctgctctttaatagactttaaatatactctgactattatttggctttggctattacatttattttcactttctttcaaaggcttttctctttcatttcatcatttttccacatactgaaatgtaaccctggtccaatggcaccaaatggaggatttatctatattgtcgtcaaactaaatgcaaacgaaaaatcaaaggagagcagagggcaccactgtattggtctcttgaatgctgaaagaaaatgtgtgcatttttctctgcctaggtagtagcaacactttatttttacataaagcctttcatctgagaatctcaaaggccttcaagatgtcatttgggtctggcattcttcaattggctgccttttgtctctttcagtaaggaaatattgctgttggatgtagttttataactgagcttgcacttgggtctgcacattcaaaggtccaagggcattgggtgtttctttttttttttttttttttttgagacggagtctcgctctgtcgcccaggctggagtgcagtggcgcgatctcggctcactgcaagctccgcctcccaggttcacgccattctcctgcctcagcctcccgaatagctgggactacaggctcccgccaacacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgggtgtttcttgaatggatcaaataaatgaccagttacgacatactcaaaacaaccccaagaggaagatgagtggcaaaggtgattactgaatttgcaggtggagcagttgtgacacagcagggttaagtgactcacctgagggcacacagtggagtctttgttactgctggaaacagaagcccatgtaccattcacatggctgtgcttctgtgacataaaacacttatctgctccttctttcaaaaggaaaatctggaagaaaaggcactcttatgcatataagaaaaagattccaatgcaagggagaaaagagtaataactttggaaatgtcaaagataaagaaacctgtggaccttgcttttccagaaaagcacacagcttctagtgaaattattgcatataaatataaaaagaatattgcttgcacatagaaagtggcagtgtgatttttaaagtttacttccttataagtacaaaagcatgtgttgatctcagctaggaagcaaaggcataatgctatatgttatatacatatacacacatacatacatgtgtataactatacatacacatttatagctggatatatatgtatacttttaagccacttgcacattttcaaacttaaaggcatttttcttttctatcttatttatagctattttattctgtcctggaattttgttttggctcattatctacaagcataggcatctgcttcaagatcgtagttattagtctgaagagcttcgaattaaatgtagattatgcctccttggcatcattatacaatttactattaactctgtgtgacagttttgactgtgttattccacttaacatttatgttttaatatcctcttgagacaccatttcacaatttacatttacttttaaagcccattgtcaagtttgggcaggaatctcaactctgctttcagatgtaaaacaacttgagtattttattccaacgagggagcagatagaagtactatgtatataattttagcagagaggatgtcataaaaaagaagactatagtttgtattcgagaataattatacatttgaaacaaaacaatttattaaataaaagtttattttagtttccctttcttttactttatattcaaggtgagtttttaaattgcaacctgtctttcatagtgaaagattcttacacaaagccagaaacgttctggaatcattctaatatcatacatactaaagctgaccttagtccatcttacttgtaattgtttacgtaaaaaaaaaaaaaaaaaaatcctagatctatgtcctctaattttctaagcttagaaattctcagatccaagctatgtaatttagaaagtttagaaaaagctgttccatatataacattggttttaccatatcggggtagaaatcttgacgtgatatgcccatttctttatctgtgcataccatctaggttctcagcttagttttgatctgctccagaagaaatatgcacaaacaagcaggagtaatgattttttaaaaaagttaaaaacttatttatgttatttcacctgaatttgagagtctagaatctgcactacattttgtcattattagtctctcttgtccatgaaatctctgctgctttgtgctgtctttggcgaagtttgagagaggtaaaagtttagcaacataaaacaatgttttaagaatgtttctgcttcatgattgctttatgagcaatatgcattttgctcttctttttcttatatacagtaatcagaccattaatattgcccttctccttggcatatgtgtctttattttgaggttatgaggtttctttttcttatatacagtaatcaaaccattaatgttgcccttctcattggcatatgtatctttattttgaggttatgaggtcttcttgcattgttaattttgccctaaatgaaagtactctttctgatgtgtagttggattagcttggggtataaatggaaaaagaaagagtctaagctctgccaattattagctgtgttcctcagccacttaaatgaatttatctgagcatctaggtgtctatagttgtatagcaaaatggatgtatccccagcactatcattctggtaattgaatatgtcagacaatgcctcagtaaaatacaattttcaattactgctctaaatcatttatgctgtagtgttccattatttgaatgataagcttgtgggagttatttgtatcctactgctcaaggtcatcgccaaggtctgatttttcacaaaaaatttgcaacctccatcataaatgggttaagttgtcaagaaatgttttctgtcagatgcaaaattttaaatctatagaatcttttaaaatgttatgtttttaaaaatcataactaaagcctgcaaagtgaagcattattttaaaaattcaaaaattatttttgaatctcaaattactatagtgcaaaaacaaaaagaaaaacttgagatccaagagcaaaaacaaaaacagtgatcaactaataacatgttcttgctatcagaagtcatttgctaatagttttacttcactattttcttgttaaagaaagtgtttgttagtaattcactgaatcaaaaattaagagtctaccataagtcattcataaggtatctttactagtcaatattagtcttattcaacagctcgtagctatgttatatgcctatgagagacaatgagtgtgtatgcttatgtaatgattagcactcttgctactgatgatggaaataatagatacaggaacgaatattggcaagaagtctttaaaatatcagttcaaaattctgcatcaaaattttctttttcacctatgatcttaaagtaaggtttagaatttgaaacttttcttaggatctacgctctggagtatttctgtttcttgttttgttttgtggtcactaaccacagagaaatttgtcttttttacatacgctggaaataatttactgcttttagaaatattaaaccacagtaaaaagccaatactaaagaaacattatgggtctgccgaatccctcaaaaagccaggaaattgagagttaatgcagaagctctgatctggctctgtgtcctaggggctttagaactctgaagtatgacaggtagtacccagcccacatatgtgcaaaaattaagacaaaaacaaaaactatttcggcaggatgtgtggtagagggcatgcgtagttagtgcaaattatctgagacactaacatttacacttacttgatataaaataatgcttttcataaacaccaattcttgtctaacacttagataaaaattataaattcaaaggcttccaatgtgacaatgtagattgtgatctgtggtatagatatacttaatggtgtagacttaacaaatatgaaattctcaaagttttaggagtaatattcacttgtattatctctgcatgtggtttacagtagaagcgatgcttctaatctattctgctaatctcacttaagaaaccagaaattcaggctgttcccacagattcggtcttgaaaataaagtctcatttatgtacacggcacaaaagcaaaagttcaatgtttgtagactacgctttttaagtgttattttccaaacattattttacatatatatatatatacaaattgaaatttataaattactcaataaagcaaatttcaattgacaaaaacatttaatctgattagctattatattgtattgaatttatttaaattacataacacttttcctcaagaccttatagttacctgttttcattttaatatttaattattacataatacacaaatgatacttgggatttttaataacaaggtttatatcgaaagtggttttatttttaaagaaattattcaacacataatttattataataaagcttagtttatatcaaaatattttcttgaattgagcacaatgctttaaatgttttaaatctataaaaatagaaagactgacaatccttaagttacagatatactcctgataatattattcaaagtgcattgtctcataatggataggatatagtatactttaaacatatttcccttgagctgaagttttgtccgaataattaaacaatgataattaatctatgaataatgtattgcttcacttacagccatattatttgctttctttgtaaatgaaagagaaaggtagtaatatacaaatgtgtgagttatttaaagtaagcatgtttggaatcagaaagctgaagatgaattggcataaagcagagagcatagactgcttctaattttaaaggaaaaagtattttttgttgtttttgacatagactttacctccccaaaagcaatttttgtttttaaaaaaagctctgttttgaaagaaattttatcctaaaaattaggcatgatagatgatgtatttaagaaacagttattattcaacatagaattaaattggttgaaaactgataatttgcctgtttgtgctagtgatttcagtaaatactggtacaataacaagtatatagtgagaaatatttaacaacccattaagctaggagttaaaatatttttatagtttggaaaggattaattgctgcattccagaaatactttctatacttactgaatttttatatattagtttagatctaaattattgttttctacacttcaacatagaaacgtttaaaacgtattgttgaatgaaggttatacaatgaagtatttccagattcaggaatacaattataatttttcacattacatattacaaattagagattttattgggttgcagttttgtgtcaataaatgaatttattaatcctactatttaacatattttccccataaacatgggaagcacattaccagggagaaaaatgagtacgtgaacaaaaattgtcattaacacacttctgaaaattaaactttgtaagtttaaaaatcacagcttcacaaataagagacagtttgcctttctactctgggctgaaagaaggatatttgacacatttacatagcaaacttagtcaatgtttggaaatcctttgtagtggccaaaagctatgcatttccttctgttgacctgatttttttcccttccaataaagtaaattaatagaagatgcatcaaacaggattattgcagatgtgcacatactgcagtactaattgctcttttatttttacaatccaatcctgcacgtgctttaatttatatttgcctgagttagttttttagtgaattagcagtatctgccacacactgaatagtaatgtgcttgcatcacgcgattatctcagatacattattgtctagaatccatgatcctaatttccttaccacccacgcccatccctttactctgtttggaaggctgatttgtgttaagagggaccaccaagctattaaccctaggacacaactagcattgtgcatagagagtagggcgtatgatcatatcccattttaactcttccaccagcattatccttgtttcccccaatgctttcacgaggtaataactccaaatgccttgcatggaaatgataaactgcctgttgtgccttttctttgaaggagttctcctgcagagtatcatatttaaataaattgccattgagtttagcaagcagcacaatcatgcccattgaggtagattcttttgatcatattttgtaatgcaatcaaggatcacatgaggatgctcaaacgggccagccttgctgtgtgctaaatagggaacaggagaaagagaacattaattgccctgaatcccaaggacataacaaagcacacctgtgttccatgtcccacagaccctaaggcagtgggtacataggcaaccaaagtaattcttttcacgtgattgattagtaattttaataaaactattagattttttaaaagaaatagctgatatcttcagattttcaaaaaatctcaaatgtgagcacataagcacagcatttttgtacttttatgtaagggaatgtactggatggcatccagagacctaggcttctggtctgcctattggttgagctggttaatgtccctgccactgatctccccttccttcacaccctatgtacaagaacaataactgcccacttactggcacagttcttttgagtattgcaggagaccatgattaagaagaattttagtaataaagtaccttacaaatgtatttttctaatagctgtgtggatatatgtgtggcacagactatatatgaagtgttccattcccattaactctttgcaaacatttttgcagtgtgaatctttctgaaaaaatgaagggcttggggcctttcatctaccaaaaatatcagtctactagcaaggaattgcctactgaaaaattaattgaggaaatctggggacactattgaacttcagcagatggacttaaaaagaggcagcagatgtggaagtgggggcttgtaaagaatttcctgctttactggtccagcattccaactttctgttaaactctgaaatgtgaatgagaaagaactaacccataccatcccaaatcatttcctgccgacagctactgtttagtaacctgttaccctgtccaccccctgcctttgatggtgcaagaaagataagtgagagagaaaaactaaaaattgagaaagtaagaaacagtttttttctatccctaccaagatcattttagtggaaatgtaatttgtttttcagaatggttcaacttagaatagagaattgtatagtggaaagaatattgctctttcataaagaagaaatgtggaggtccagtcatagtctaataccttacctttgtgccaaaacggaagcagccaaaaatattaggggtgggaaaggcacacctttgttcctagagggtggtgactgaggttctttcataaatgttaaacaatgtttataattctatattcttattatgagctaaagtcaaataacctgaaaaataaattactgggaagacaaacgggctgaatggcttttatatgactttggagtctgaattaattacctagagctgctataacagaggaccacaaactgcatggcttaaacaacaataatttatctcacaattctggaggctggaaatttgtgagcatggtgtctgcagggttggtttcttctgaagactctccttggcttgcagaatttcacctccccgtgtcttcacatggccttccctctgtgtcggcctcctaatctccttttcttatgaggacaccagtcatattaaatgacggcctgccctaatgacctcatttaactgtatttacctttttaaagattctatctccaaatatagtcacattgtgaggtactactggggatgaagagtttcacatatgcatttttagggaacacaattggccccacaacagagtcctttttttctgtccaagcagtattgaaaagatgctgcctcaagtaccctaggggtaaaatttcttccctcaattcctactgatattatagaaaacttacaatgtattttacggtcctgacaattacaggtgggattcataggagatatattgacgtgacttttggattctaaacagtgctgagataattaagcagaatctgaattaagattggaagtggccacccaggatatgataacagttaaataatctagaaactacttttttaattgcgttaggagagagcaagtattctcatggctgttctttctcacatagattcacataaaccatccacaacccatccataaacctgccttatgtttccccatagcctttgtttctcacctttccaaccaagtagctctggccctctcactcccaccttatcctataaatgtaaactttatagggacagggcattgtgtttttcagtcacctctgtaatgtcaatgttaagcatgcagtgaaagctacatacatatttgataaataagtattaaggttgttgttttatataagaggctaaagtttggacaccaaattcctctttatttcatcttgtactttgccgatcacaggagcaataagaatatcagggtttcttacgagtccaacatgtttagtaaagctaaagcacttaaatgaagctaaagcatggaaactatggtagaagttgcagtcagatcaaagaacatcttggtagcagccatacctgcgagccaattggctcatcagattaagaatcagatgtttataatgggaattagtactagtaactaggcatatatatgcgttatctctaatccttaaagtaactcatagtgtaatatatataacctccatttcacaaataaggtagtgaagttcagagaggtttgaataacttatccaggagtccacagtcatttaactgacagacccatgagttctatttaagtctctcaggttccaaacaccatgactttacctcttactcaacgttgtatctctctagtcaaaatgacccccctagtggggctggggagatctagccaattacaacctaataatatttttatatattctgcttaaaaatttttccaaatactatttttcttgttagtaaagttgaacaaactattgacttcttgttgtaaatacaacatgtgtaattaaaagctgggtggtattttccgaaaagaaaggagaatgatttgtctgtgctcgactggttttctcataacttgacttcaactaaccttattaatcaggacaatgaagaaaaattcacaaggctcatgagtcagcccattttagattctcagtgtcagcatatggtctcaaagcccaaatgcgttattttcacacggtgcatctttgactgtttattacaggggaggtagaagaagaggaaagcattcttttttgttatacatttaggaacacagttaaatgtctttatccccaaaggcaacttggcagttttgggcttggtgcccacattgttaaagctgcgtttgttctcaagcccctagaaggactttttaatattttaaatattctagtttcttcatgtcccctccctatcctccagaggaattgtttaaatcatatgattgatctatttttaagcagcaattctgtcacgactgttcagcagggagacttgttttcttttaactttatggtactttatataggacctcttagtcatgttcatagaatatcaatcaatctgtaatcccagtctcatgggtttttttaatgctttatgaattaaacattgtattgtatgcatatgactgaaaacccttcttttcaaccacaggaataataagttctaaatataaattaagtaaaaatttcccctccttatttaattctagtgatttaattttaatacgggataggaagaaatgtatttggatttcatgattcttattgtacatagaagattttaaattaaatggttggtgacttgaactaatatgcaggccatgtgttttgttcacttacccaagacccccatttactgctacacataggtgaggccattggcatccaaggtcagtgcttttgattcaaatctcccttgtgccagctcagcaatgtgatactgtgcaaggtgcccaatctctgtataccggtctcacatttgctaagtgatgttacctatccataaacgtgtgtcggttaaatgagattatctatgtaaaagatttagactagcatctggcacttcatacttcctaaaaactactcaatcttgttataattgtggtcattattatcatagaaaacatgaaaatatcaccctttgcttttgtggaaaagaagaaaagctaatttctctgaccttttctcctcctttccaattctgtgcctgttgaaaacagattttctcagctttctgtctgatgccagcatggctgcggtaaaactaagagcaccaactcactacctcaaatctgaatttgttgctagcattggggacacttaagttctttccaagctacagtgaaaagtgcaaaagagtgtgtgtgtgtctgtgtgtgtgtgtgtgtgtgtgtgtgtgtgttagagagagagagatgagggtttggaggctggactcctaaataatattatttcggtgggataaattgttttcatcttcagctcctccctttctcttggtaaatctaatttacttgcagtgactcactgcaagtgcagctggaataaggatggctcttccccagcaatgagaagggttttaaagctgtttctgtcttaaaaataataggtgggtttctattgggtcggaagaaggtgtaggcactaacaagttaatatctgatttaatattaaaatgaaatatcttggcacatttttgcaaaaattttgggattattgccactaggtatagacatggaggaatggaaaaatagaaagatgtgaaatagatcttgtatgtcactctttgcaagccatgacacttcctttggcaatagtcctgctacttgtgtgcattgaaaccaaacaatcaacaaccagaaaaacctagaaaacatagtaaacttcttagggtgaggacagttagcacataatttaatgtcttgggggcaataccatgcttgctactccaacaaatggcacatgttccgtgctgtcagccttgaggatttgaagctgccagtgtctcctaaataattgtgagtcagtgtctctgcagcacttcaattctacaattaaatatctgataaatagccatactatctcttttctcttccccactatccccctttcacagaaaatttcacttttattcttctttcacagacataacttgcataggagagctagcagaaagtcactgcatgagagtaagtcaggggaagccctcgccaggactgttcttcctgcctcttcttggcagtacccgcacagcacccctcctcatttccactaatgtgtcagccacaggaataagaacttctgcaaagcacgttttaggctttgctatgtattaatttatatacagctatgtattaatttatatatgtctaaaaactctgggcttttgaatttgctatcttgctcatcagtgtcacatgaaatctactttatcattcaaattagaggaaataatatgttctgcatttttacaaaatgtaagactccctcacagttcctgagatctgagtttggaactggaaatggaccttcccagagctaagttaagtctaatgttgtcaagcacagcatcacggttcagagggaaaagagaaaagcatctaaccaaggttcactaagtaaaaaatttatcagttcccttagtcagcaaatgctgcctcagaagccacgctaatgaattgcatgttaatgaatcagaaacagaggtgtaattaacacaagacttcaaagggaaaaaaatacttggtcatatgctttttcaaattttgtaaatattgttcagttctacaactgatatgttaaaaagcagattttttacagcttactcaggcatagtacacatagcatacagttcacccatttaaagcatacaaaccaatgatttttaatatatttacagtgcaaaaaccaatacagtacattttataacatttttgttatttcaaaaataaactgatactacttaactgtcacctttctatgctcctatccccaactcttcctaaacaatcactaatctactttttatctttgttgatctgcctattttggacattttatataaatggaattacacaacaggtggtcttttgtgacttttttcacttagcctagtgttttcaaggtttatcaatattgcagcacatatcagtgcttcagttctctttatgaccgtatatgagtatacattttgcttatccattcatcagctgatggaaatttgagttctttccactttttcactgttataattaatgctgctatagacattcatgtgcaagttttagtttggatgtgggttttcattccccctgagtgtatgtagccaggagtgagttgctgagccatatgatagctctatgcttaaccatttgaggaactaccagagtatcttccatagtgaatgcaccattttacattcccaccagtagtgtatgagtattccaatttttccacatcctttttaacacatgttatcatctgacttttttattctagccatcttagtgggtgagaagtggaatcttgtggtttccatttacgtttctctgatggctaatgatgtcaagcatcttttcatgtgcatctctcatggccattaatacatcttctttggagagctgcatattttaatcatatgtatctttataaattgggttatttttcttcctattgttgagttgtacgagatatgtatgttctagacaaaagtttgttactatatatatgatttgcagatgttttatcccattctgtgggttttctcttcctttcttgatattgctctttaagcacaaaagtttttgattttgataatgtccaatttatctatttttcttaattgttcatatttttgctttcatgtctaagaatttattgccaaatccaaggtcatgaagacttatacctaaggtttcttctaagggtcttatacttttgtacttatattgaggtctttgactcaatttaagttaattttgatgtatgatatgaagtatatgcctaactttattcttttgcatgtgattatcaatgtgtgccaacaccagttgtccaaataattattatttctccattgaaatgacttggaatccttgttaaaaatcagttgaccatagatatgtaagtttaggttcttaattctgttcatttgatctatatgtctacgtctatccttatatcagcatcatactgtttgatcaatgttgctttccagttaagttttggaattgggcattgtgagtctttccaatataatctttatttcaagactgttttgtctatactaatctcttgaatttccacagagattttagaatcagcttgccaatttctacaaagaagtgagctggaattccaatagggagtgcagggaaatctgtacatccttgggcagtattgtcatcttaaaaatattaggtcttccaatccatgaatacagtacatttttccatttacatagatattctttaatttatttcaactatgttttgtagttttcacagtatgtcttactcttcttttaaaatttttatttctagttatcttatgtttatgctactgtaaatcaaatattttgcttaatttcattttcatattgttcatcacaagtatacagaaagactgaatttttaatattgatcctgcaatcttacagaactcatttattagttctgctaattatttctaaagtgcatttatatttagacatttttccaagatcaaggcagaattcaaaaattaaaaataaaaattaaaataaatttaaagatatgtatagatggccaagcatggtggctcatgcctgtaatcccagtactttgggaggccgaggctggcagatcactggagcccaggagttcaagaccagcttggccaacatggtgaaacctcatctctactaaaaacacaaaaattagccaggtgtggaggtgtgcacgtgtagtgccagctacttgagaggctgaggtacaagaatcacttgaacccaggaggtggaggcgaaagttgcagtgagccaagattgtgccagtgcactctagcttgggtgacagagtgagactctgtctccaaaaaaaaaatgtatagataagctctagatgacttttctttctttatgttacttaattgctatggctagaacttccagtagaatatggaatagaagtgtgagagtggacatccttgtcttacttctgatcttaggtagaaaaacctctagtctttcaccatgaaatgttagctgtgggttttttgtagatgccctttatgaggttgagaagattaccttctattcctagttggttgagtatatttattatgaaacagtgttggagtttgtaaaatgctttttctgagtctattgagatgctaatgtggcttttgtattttattctgttgatacggtgtattaacattaattgatttccagatattataccaaccttgcattcctgagatatattccactatttcattgtgtataatcctttttccatgttgttggatttgttggattcacatggctagaattttgttgaacatttttgtatcaatttttatgagacattgatccatagttttcttttgatgtctttgtcttgttttggtatcaagataacactaaccttgtagactgagttgggaagtattctttcatctttaattttttgaaagagtttgtgaataacttgtatcctttaaatgtttggtaaaatttagctgtgaagccaatgggcctgggcttttcttgtggatacattttggattatgaattcattttctttacttcttatagtgctattcaggtggtatattcttgtgttaattctagtagtttgtgttattctaaaaatttgtcttttttatctatattatttgatatatttgtagatgattctcttatttatctattgagaaagggtcttgctgtatcaccctggctggagtgcagtggtgggctcacagcttactgcagcctaaacctcctcaggcaaggtgatcctcccatcttagccacctgagtagctgggaccacaggcacaagccaccaccccctgctaatttttttttttttttttttgggtagagacagggttttgccatgtcacctaggctggtcttgaactcctggcagtttgcccatctcagccttccaaagtgctgggattacatacaggcatgagccactgcacctggcctgtatatgattctttgtcatgttctttataattaattttctttctctaaggttagtcaatatgtcctctctttcatttctgattctattaatttaagccccatccattttttcttggtcattctagctaaagtttcatcagtttttgttgattcgttcaagaaacatttgatttcactgattcttagctcttatttttatattattgttgtcaatttctgttctaatttttattatttcctttcttccatttcaggtttacttcgctcttatttttttcagcattttaaggtacaaggttagattattcatatggtatatttctttctttatttaacataggcacatacaggtaactttcccagtaagtactgctttaattgtattttgtaaattttggtatgttgtgtttttatttgttttcattacaaagtattttctaatttcccttttgtttttttctttgactcattagttatttaggaatatattgtttaattttcacatatttgtgagttttttttaaatatctgtaattgacttcaatttaatcccattgtgattagagaacatactttatattatttctacattttcaaatttattttgaaagtgtaggtttgttttatggcctaatgtacgtctaacctgaggagtgtttcatgcaaatcggcaagaatgaatgttctgtcattgttgagtggagtggagtgtcctataaatgtctgttaagtctaatttgtttacagttttgtttaagtcttctatttccttgttgatcttctgcctagttgttctatccattattgaaagtggggtattgaagtccccaactgttattgttgttttctatttctcccttcatttctgtcaagttttccttcatgtattttggtacattcatattagttgtttataattgttatatcttcccagtgaattcacccttttgtaattataaaatttatatctttatcattaataaaacttcctgttttaaagtttatttcatctcatattagtatagccactccagctttcttgtgggtgctgtttacattatatatcttttttcatccttttactttcagtctgtttttatctttgactctaatgtgtatatactgtaaacagcatatagttgaatctatccgttttaaaaatctgtcagttggttgggatatttaatctattcacatttaatgttattgatacagttgaatttacatctgccaattaactttttgttttctgtatctgtcatgtcttttttgctcttctattcctgctttagggcatatttttcattaagtgaatatattctaatgtaatattttaatttaatactttttttcatcatatatttttagaattattttctggtgggttactctaaggcttattatatatagcttaacttctcagaatcagctttagatttatgctaacccaatccattaatacatagaaaagttactgttatacagctgtattctctttttccctctttgtgctattattattttacatattacatctataaatattgcaaactcaacaatccattattataattattattttatatgttataatttttaaatactgtgagagaagaaaggatagcaagtatgtatttacagcttttgttatttaaatcttatttattatttctggtcctctttatttgttcctgtaggttagagttattatctagagtcattccaatacatctttgtttccacccatctcctttgtgctgtcagggttaaatatattatctttctttatgttatagacccaataatacactatatatacacacacacacacatacacgcgtatatagttttatgcaaatttatttaaatcatttaaaagaactaaggagaaatatttatttatactttatttaataattacaaaattacctttactggcactgttttttcatgtggactcaaattatcacctggagtcacatcctatcagcctgaagaaacttctttagtatttctagtgaaagggagatttgctagtcaaaaattctctcaattttttttatctgtgaatatctctatttcatcatgtattttatcccactacttttcagcttcttttttttttttttttttgagatggagtctagctctgtcaccaggcttgaatacagtggcgcgatcttggctgactgcaacttccgccttccaggttcaagggattctcttgcctcagcctcccgagtagttgggactacaggtggccaccaccatgcccagttaatttttgtatttttagtagagacagtttcaccgtgttggccaggatggtctcagtctcttgaccttgtgatctaccgaccttggcctcccaaagtgctgggtctagtctattttttttttttttttttaatgagaattcagatgttaatcttactgggttttccttataagtgacatacttttttttcctcttgacgtttttaagattttctttttgtctttggcattcagcattttttcacctgtatgttgaaaagtttttttttaacatttttatgtttttctttttaataattggactcagcctaatgcaccccatgtttatccattttggggaagtaaaacaacatgtattaatgaatattctcccaaatgtttaatatggcaaagctttactcaaataataaaagcattaagttttctctgagtttttgttcttataaaacacatttgaataaaatgcataactttgtaaactcatgaggtaccttaagagtatccccagaaataggccagtgcacagtgggcaggaagccagggctgactcttgaaataaaactgacactcttgaaatcccttttagggtcccgttcttgaaaaacatcccctttatacacagttgctttgtgttctcccagcaatggtgcatcccttgggcctatgttattgtattatatttatttttcccatcccacatatttgtgagttctttggaagtgggtgctttgacaagatcagcttcacactccccaagcataatacttggcactaatccaatcccaagtaatagaccactaattccaaacgtaacatattcaggtgaattcatccctactgacataatttattgcctcagcacagtactgttgattatttatttattcctttatttatttattcacaacctgggtgcctttaagggggtcctaaacttccagttaccaccatggctctcccaaagcctttgaccttgatgttctccaactcctgctgcctggatggtccctggaagtcctggggttttttatccttttcaaaaataatttatgcaaactaaatgactgagtaaatatttaattatgtagatcaagtttcttaatcaaatattcatgaattggcttctggtagttaatttttgttcctttggcatttataaataatattattgatacacatatataaatgtattttcatggaaagaagatccacagttttatcaatgatgagtataggtagccaccgtatttcctcaattgtaatatgcaccattgatttagtaacagtcttttggaaaaattaaaaattaaatgtatgcagtgtttttcaattgattttacaattcaataacattttcttcaatagcacaatcaaatttgattatgagacttttacaaatttaaaatctagataatatttctggcaccaatacataactaactgagttgaaaaagtcaatggtaggcagaagtatttctcttatgcatggctacatttgtaactgtatagggagaaactacaattggtgtttcattggttatttttctacttagcaactggcaaagtttcttttgacagtgattacaaaatacatataatcttcataaaggttaaaattttaatatgtttttggaaatatggtgtttatgtagttgtaattgaagttctttagtcaggaaattaacccatatttataatgaaaactgtatatggtttaatatacagactcttaggaaacaaactgtaaaggttacattgctaattttgagacagttttccagtttttccttcctaaaagagactggtaattattagtttggctgagggatggcctttgctaactataactgtttattctattttgctctcctttcacaaattctgatcagtgctggaactttagcttcctaactcagggacacgattcccaagtctcaatctttcctcttgcagtttctccaagtataatctttgaatacgtattcttggctgcaatgctctaactcattgattgtgctgtgttggcaatagcatggtctatgtaatgctaagactgtgatacagtgatgatgaaaagagttttcaagggctctatagagatgagtctcttttcttactttgattatgaagtgaaatatggatcaccaattagtagagtgtgattgaatcatttgggcagaactactatggttgcctcaatactattaccattgaattgcttcatatctcaatgtgtggctttcaatagcaagaatttagttgacaagaaggacttgatctatttaaaagcatcctaataatgataggttcaaatctatagtgcacctaattacaaagatgtaagttagttcctcaaccatgttatcatttgtggataaaaatagaacagcaattgagatattagaggaagttttggtttttcttttttgtgtttgatggaatgagaatattatgcaaagtatgaggtttatcttatgcctttttcaagtagcataaaaaggtaaaacgcatcttctgttttccaatttcatgtgctttttctcttaactaactgtgcaatttatgatgccttccatgtatgactgttttgattcctcatctttgatattctagagtcaagagtaattactagcacatggtagatgcttagaaattgcatgttgaatattatgagcacttagatattgattcttaaatatgtagtttttttttccctcaagaggttttgtgaacttccaaattttatactgagtgactttatttgagaaagtgtgctagtatgtatttatttcacagtttccagtaatctcgattatcataaagaagtcaagtgaaccttcacaaaattagttctgtttatatttggtgtccacgtatattaagaaattcaaatgtacagaactatcttctcaggcttctctttaggagaaaatgatgttataggtgaatttcaaggtaagaatgttgccagaaagtggtcccaattcagacccaaagagaggaaggtaagaatgttgccagaaagtggtcccaattcagacccaaagagagggttcttggatctcacacaagaaagaatttggggattctttccccaagtccacggaacaaagtgaaaggaagtttattaagcaagtgaaagatgcctactccataggcagagcagcagcgtgggctgcttgattgagtatacttatggttatttcttggctatatgctaaacaaggggtgaattattcatgagttttctgggacagggatggggagttcctggaactgagaattcttccccgttttagactatatagggtaacttccagacattgccatggcatttgcaaactgtgctgatgctggtgaaagtctcttttactatgttaatgcattataattagcatataatgaggtcacttttgttgccatattggttttggctggcttctttattgtaccatgtttatcagcagggcctttgtgacctgtatcttgtgacctcctatctcatcttgtgactatgaatgcctaacctcctgggaatgcagcccagcaggtctcagcctcattttacccagcccctattcagttgtgatttggagtagctctggtttgaatgcctctgacaggaaaaatgatcaaactaggaatgtttcatggggttctatacttagatcagataatcagacagaaaggttaataactaaggttaggaaaatgtggtgttgatgatgatgtgtgcagatagcaagtggtgaagtccacaacggggaaaattgataacaggagagatgggagcttatgaacagacggaagcaactggttgaatacagaggtcgaaaagaggcatgaatttaggatataggtttaattagtacttagcatgtgttttgaagacatggatgggagcccacagaaaccgtttttattatagatatcacaaaattttgcttttaatattttgggtatttaatgaaattgtcttattttatagtcttttctcttgaaagaaggaggagaatcaacctttagatactccttctagatgtgtttataccatatttaactaattagtgaactgaacaatctagtggtatatatttttatgcccattttacagataaggaaaaggaaattcaataaatttaaatccatctagttaggcagtagtagaggtgggatttataccactctgttacagtacaggtgacaaaaatagaaaattcaaagacttcagcttctaccatgaaaaagtaatcagttccagttttgccttactgctataaacaactagagaacaggacgaaaatatatgaagcaatcatttttacaaattggacagtaggcagtacaggactgtgatctttgagagaagagaaataaacaaagtgagctttatgattgcatcatctttctgcctaaaggaattttcccgaccataagacagggatgggacccaatgaaagcacgatggtcttgctgggtaaaaaaagagattattgttctgggaggcaaagccaactgaactcacaaaatccctcagaggagaaaggtgactagaaaaggagcattcgagtttgcatagaggtgacctgagtctgtgactgattactaaactatgcatttataggctggaacatgaggtcagtctcagaactactagggagctgtaagttgaaaaattcttagagctcacctgcaaatggcagatatttgtgttccaactagtcagagggaagaattgttgaacatctggggcattcaatattaagtaataaaatacaatgtgttaatagtaaaactaagctaaatgtagaataaaggatactctagacctgctctaatatgatttatttgtattggtacatactatttatgcatatttaaggggtatatgtgatattttgttgcatgcagatatgtgtgatgatgaagtcagggtatttagaatatccatcaccattagcatgtatcatttctgtgttgaaaacatttcaagtccttacttctagctattttgaagtgaacaatacattgttgttaactataatcgcttgctatagtatcaaaccttagaacttattccttctagctaacggtaattttgtacccattaaccaacctctcttcattccccctctccctacacacccacagcctctgataactattattctaccctctacctccatgagatcaactgttttagcttccacatatttgcctttctgtgtctaatttcacttagcacattgacctccaattccatcccatgctgctacaaatgacagaattttattcttttttaatagccaaataatattccattgcataaatataccacattgtctttatccaatcacctatttatgaatacttgggttgattttgtatcttggctattgtgaacagtgctgcaataaacatggagctgtttgtatcccttagatatactaatttcctttccttggataaatacccagtagtaggatggctggattgtatggtagttctgattttagttttatgagaagtcttcatattgttttccataatggctatactaatttacatttccactaatggcgtatgagagttttttttcctctgcatccttgccagcatttgttatttttttagtaatagccattttaactggggtaagacaatatttcattgtgatttgatttgtatttccttggtgattcttttgaatgctcaatacactgtcagccacgtgttttgttttttttgttttgttttgtttttgagagatgtctatttagatcctttgcccactttttaatgggattgtttggtgttttttgttagtttgttttatatgctgttgaattgagtttttgtatattctagatattactcccttgtcagatgactattttgcaagtattttctctattccattggttgtctttttattcttgattagttcttttgctgtgcagaagctttttagtttaatataatcccatttgtctatttttggttttgttgcctgtgcttctacggtgttagccataaaatattttcctagaccaatggcctggcatgcttcccctttattttcttccaatagttttatattttcaggccttatgtttaagtatttaatccaatttgagttgatttatgtatatggtgagagataggtgtttagtttcattcttctgcatatgggtatctaattttcccagcaccgtttactgaagagggtatcttttccctagtgtatattcttggctcctttatcaaaagtcatatggctgtaaatacatgagtttctttctgggtctctattcttttccattgacctatgtgtctgttttggcacaaatattgtgatgttttgttgactctaacattgtaatatatgttaaagtccggtagtgtggtgcttttgtctttgttcattttgttcaggatcactttggccatttagactcttctctggttccatacatattttaggattgttttttctctttctgtgaaaagtactattggtattttgatagagctggcaatgaatctgtagattgctttgggtattattatcattttaacaatattagtttttgcaatccaagagcataggatgtcttttcatttgtttatgttctctccagtttctttcatcagtgttttgtaatttttttttctgaaggttttcatgtacgtggttaaacttattcctagttttttttttctgctagcaattgtaaatgggattgctttcttgatttctttttcagctagttcattattagtgtttataaacattactgatatttgcatgttgattttgtatcctataactactgagttatctgtctgatttttgatggagtcttgaggtttttctcaatatacaataaggttatctgaaaagaggatctatgtgatttcctcttttctaatttgagtgccttttatttttttctgttacctgagtactgtggctaggactttcagtacaaggttgaatagaagtggtgaaagtgggcatccttgtctaattctacttcttagagtaaaagctttcagattttccccattcgttatgatgttagctatgggtttgacacatacggcctttttttaggttgaggtatgtttcttctctggctagtttgttgagcatttttatcatgaaggaatgttgaattttatcaaatgctttttctgtatctattgagacaatcatatggtttttgtccttcattctattgatatgatgtatcacattaattgatttgcacatgttgagccatccttgcatccctgagataaatctcacttgatcatggtgttctgggtttttctgatttgtattgaatttggcttgctagtacttactgaggatttttacgtatgtgttcatcagggatattggcctgtagttttttttgttgttgtgaccttgcctggttttggtttcaaagtaataccagttttgtaggatgagttaggaagaattccattctcttcaattttttggaatactttaagaaaaattggtgttagttcttctttataagtttggtaaaacttggacttttcttttttggtagactttttctactatttcaatattattactcattattggcctgtacaggttttctgtttctttatggttcaatatggtaggatgtatgtgtccaggaatttattcattttctctaggttttccagcttattagcatatagttgttcacagtagtctctgatgattttttgtatttctgtggtgtcagttgtaatgtctcctttttcttttctgatttcatctgagtgttctctttttgtcttggttagtctagctagcagtttgtcaattttatttatcttttcaaaaaatcaactttttgttttgtcgatcctttgtatttgtttttggtctttgtttggttttgctctgatctttattatttcttttaataattttgggttttgtttcctcttgctttcctatttccttgaggtgcatctttaggttatttatttgaagtctttctacttttttgttataggtgtttattgttgtaaacctccctcttagcactgcttttgctgtattccacaggttttggtatgctatgtttcctttttcatttgtttcaaagacatttttttttcattcttaatttcctcactgactcaatggtcattcaagagcatattgtttaatttccatatatttgtacagtttccagtgttttattgttattgatttctggttttattctattgtggtctggaaagatactagatatgattttgatttttaaaaatttgttgagacttgttttgtggcctaatatatcatttatcctagagaatattccatgtgctgatgagaaaaatatgtattctgaagttgttgtataaaacgttctgaaaatgtctattaggcccactggtctaaactgcaaattaaattcagtctttctttgctcattttcatatagatagcctaactattgctgagagtggggtgtcaaaattctcaactatcaccgtattgggtttatatctccctttacacctaataatgtctgctttatatatctgggtgttctgatgctgggtgcatatatgtttagaattgttatatccttttgttgaattgatgcctttatcattatataatgacctgtttggtctctttttactatttttgacttaaagttactttttgaagatataagtatagctactcctgtgagctttatttccatttgcatgtattttttttttttattcctttactttcctcctatatgtgtctttgcaggtgaagtgagtttcttcttgggggcatacaatagggccatgttttcttattcatttagacagtttatatcttttaggtgaaaaatttaatctgttgacattcaagctcattatttatatgagaggacttattcctgccattttattaattgttttctggtgttttttttttgtatatttcattttcttttctttctgtcttattgtttgatttctttttttttttttttttttgtagtggggacatttgtgtcctttcttgttctcatttgtgtgtttactctaccagttagtttcatactttcacacattttcatgatggcagatatagtcctttcacttccaggtgtagaattcccttaagcatttcatgtaggtctagtttagtggtgatgaatttcttctgtttttacttacctgagaaagtttttattcctccatctttatgaagtataactttgctgagtatagtattctggaatgacagttgtttccttttagcactttgaatatatcatcatattatctcctggcctgtaaggtttctcctgagaaattcacttttactctaatgggagtttctttatatgtgactaggtatttatctcttactttttttttttttaagaaatttctcttggtctttgacttttgacagttaaactgtaatgtgcctaggagaagacctttctgggttgtatccctttgggtttatctgagcttctcatatctgaatgtttaaacctcttgctagatttgggaagtttttgggtattattttgttaaataggttttctctgccagtacatttctcttcaccttctggttagtgggttcaagcaagcctattcttggggctccagatggcttatgtgggtgcctgtagtgacagtggtgggtcaggcatgagggtgagttcttgagcccctgagcagcatgtatgttatgggtgatcgtagtagcggtggctggacgttccttgggcttccaggcggtacttgctcatgttagtggtggcagtgtgacacaagtgggccagtccccaggcctccatgtagcatgcgtatatggatatcagcagtgttggttgtggcatgctgctcaggttgatcctcagacccccaggagaactgcccatattccagtggtggtggatggggcagagtaatctccaggcctccagatggcatgcttggacaacagcagcaggttttctggacctgttgttaggccttctggtggtgcgcatgtgccactggggtgactgatgaggtgggcaatccccaggcctccagatagtgagcccaagaactaggagagggtggtcccaggtaggcaagaacctattctcaggttcccccaatggtgtatataggcatctctgttaggcagggcagagcaagctccagacacattaggtgccagctgtggcaggcattctgaggctgtaattagaatgcataaatagaagatgagaaaaatggataaatcgaagatgagaaaaatggataaatcaaagatgagaaaaatagaaaaaatgagacaaactccatcatgtcagtgcttgcattaattaaatataatctaaacgttctagttaagaggcagagattatggaatattttatatatacaggcccaaatatatgcaatctattaaaagattttacaatatatgaaatcataatatataaatatatgttttattgtatatacatcgtacaaatgttaaaagtaaaaggatgggaaagatataccatgcaaacatgttatatgataactctgaaatgattatattaatatcttacaaagtagacttaacaagaaatatcggggataaatagagattatttaataataataaaaagccaatccatcaagaagacataaaaatttaaaatatgtttgcacccagtaacacagcttcaacatggctgcttcaagtattgacagaactgaaaagaggaataaacagttccacaattatagttaagattccagtaactgatagaaaatgtacccagcaaatcagtaaggatacaaaagacttgaaaatagtatcaactaacttgaactaattggtgattataacatatagtaagcagaatatatacattctttacaagagcacatggaacattcacaaatatatacataactcttggccatagtctcaaaaatgtaaaagaattgaaattatacagattatctgtgcttaactctgatcacaatgaaattaaattgaaaatggatagccaatagttactgtataaatattcaaatatttaaaaattaaataaccctcttctaaataaccacagttaaagaagtcacaaattagaaaatattacaaattaaatagacatgaaaacacaacatattaaaatttgtgagatgtcactaaagcattgcttacagggaaacttaagatttaaatgcttattttagtaaagaaacaagttctaaaatacatgatcaaggcttcttctaaacaaaatagataaagaaaagtaaactaaacccaaattaagtagaagaaagaaaatagaaataagacaaatattaacaatataaacatcaatgaactaaaaggcatatgatgtttctaatttctagcatttcttgttctttcttagagtttccttctctttagtggcattacccataagtcattgaatgctatctaatttcccattagagaccttacgtattagagttatttttaaacctcgattaatacaaaatctgtgccatatctgggttgcattctgatgcttgctttgtttcttcatactgtggatttttagctttttagtctttagttgtttaacatgctttgtaattacatttgttaaaagccggacatgttgtatctaataataggcctttaatgtagagttttatgttaactgtagatgtagatgacagagcattcgaattcctctagtgtcttccctgttgactttggacttccctgaggactcctccccacagagagcctgtgccttgcagcttgttcatccatagcagactatctggaaaacagagccctcttgtgtggtggtaaagtctagtgggaagaggggaagtcttacgattaaatattaatcatttagtgtgtctgtgttccggagctatgacttcacaagtgtttcttagctattttcccccatccccttaggtgaaacaggaagtctaaaggggcctagggtgggagaaatgtcattcactcagtgggataatgctctggtaaagtctttcatgttaaaagtaaaaggatgggaaagctataccatgcaaacatgttacatgataactctgaaatgattatattaatatcttacaaagtagacttaataacaagaaatattggggataaatagggattatttcataataataaaaaagccaatccatcaagaaggcataaaaatttaaaatatgtttgcacccagtaacagcttcaacatggctgcttcaagtattgacaaaactgaaaagaggagtaaacaaatccatgattatagttaagattccagtaattgatagaaaggagtggggagacaattgatagaagagagtagggagagtaggcctttgttatggagaacattctaagtgcatttcaaaatgataactcttcctttaccctgccagagccacaagggtacctttctctactcttcaccataagaatttgatggggttcctggggacaaacatacagaaatgcagagaccctctaagactgcagcccctaatggattcctactctcacattagtccaaattcagcctccaacaatttatcaaaattgtaatttaatttttcctacccatttatggctccaacggctttggcttccaatgcatagatctcagcagtgaacttctaaattctcttgtctccagattcattgtgctcatttgctcttagaacttacctttccagtgggcccaaaaaagtcattgacttttgtttcattcagtttattgtttcttgttttaaggatgaaaataacgacatccaatctctttgcatattggagataaattcagagtcccatccattgagtttttaaatttcagttattataatctttagttctaagacatctctttggttccttttcatatcttctatttcttctttgagacttcctaaattgcatttgttccaagtgtatttgtaattgctcatagaagtatttttatgatggcagctataaaattctggtcagataattccaacaactatcatcttgttgttgacatctcctgattgtcttttctcatcagtttgagctgtcccggattcttttcatgacaagtgagtttttcattgatacctggatattttgtgtattatgttacagaattttggatcttatctaatcttccatttcaacaagcttcttctgaccccactccattgagtgcaggaaggtgccacatcattactgccaaattacagtgaaagtccaggtttttcacttggcctccactgacattaggggtcaggagtaggggacccccataggtctttgctgacactactctggccacttcttgggtcctgatgttagtagcttgcctatcttctttctatcttttatgtttgttttttatatgacatacaggcttttaaatgtattttatttttcccaaaaatcaatgatgctacacacacaaagaaggcataaaaagattattactcatgtaatgaaactttttgaggagagctgtggacaagggcttgagaaaacaagggaagaagatgggctttcagctttatggcagttgggagtggggctgagggaagagttcctgtctgtgagcccaggcttacacagtttgaaattcccactggcaccaaaggagggagcacctaagctttcttatcagcatccctatataatggagcaagaggggtaggaggaggagtgaaacttaaaaaatgtcaaaaattaaacattaaagtggagtccagactctttattacacaacccaaatatccatcacggtgactatataaagcaattgtgacatatgtatacaatggagtagtgttcaaaaataaaaattaatggactgctcacatacggaaaaacatgggtaaatctcaacaagattttttgacaaaagaagtaagacagaaaagaaaacatcctatgtgatactatttgcatgaaattctagaacgggtaaaactaatccaaattgacaaaagaattgtgcctttgtttacttgggcttggggaaggggttattgacttcaaagggacaagaaggaacttttttggatgatggaaatattctatatcttgattgtaatgttgatcatatgtttgaatatgtttcccaaaacatgtggaacctgacacttgacatagctagaattttttatatgtaaattatacatcaataaagttgaatagaaaaagaggaaccttacaaatgaagaaataaaaatgaagtatagacatgtgaaaatgtctagccttgcaaatcatactagcaattaatttgtattttgattaaattttaaaaaatggtatagatcaaagtgattcagtataaattctgataaccacttattagctaatagattaatttgggaaaattacttgatctctttgtgtcttttttcctacctcagtaaatgggacaaatattagttaatacctcaagagttattttgagtactaaatgagtaaatataccatagtgcttagaacagggcctgggaaaaaataagccaatgttaaatattagctttactatgtttttacaagcctctagggaaatggatactttcatgcacagttgctggaaatgtatattattgcgtttttttgaggtcacttcatataaaatccctttaaaatgtgcattaatttggccaccatttccatccctgggaatgcatactacacaattaattgtgtgcaactgcaaattttcttcaaggatatataattatatcattgtttatagaaagaataaaaggaagtagcacaaatatccacatttccaaatataggaaattaagttatggtgtagtcatatatgactttcttgaatttccataaaaacatgtagcaacatgcaacaacactataaatcagtgtagaaaaaatttcaggttaataattaatgataaatcaatgcaaaaacattggatacataacagcaggaaaaaagtaaaatgctaaaataacctatgtaaaaaattttagcactaaaagggagaacttatacagaaaaaaatagtcatatctagctgtgatttcctagctttatgatcatcaataattcacataactttttagagcttcagtatttctaagggttaaaatagggacaagtatacaaggatatatatatatatatatatatataaatttcttagattttgtgaatatattaattgagttgtcacatattaataaaacatgttaagtgatgaaaaattgtggttattattattcaaatcaatttaataagacacatgagtagattaacatgccatttttgggggatagtaaaactaaatattataaagatgcacagcctagcaaaaatttaagaagcatcacaaaaatccatttataactctaataagatatttactgaaatacttgctacattcatttggcaaaacaaacagtaaacatatctaagaacattaacaaaaggacaaagtgatgagtcttaaaaagtgttttaaagctacaataattaaagcaatgtggctatgaagaaatcatagtcaagtcagtaaaatgggaaattataacaaaaatatatttttatctattcatattgatttagatctatatatggatataagaattatatacagtataaaagtaaaattaaaaatcaatggtaaatagatttctcaatattttatatcagaaaagttgaataaatatttgaaaaaattaggtcttcacctcacaccataaccacaaaatacattttagattaagaaactacttaaattttagaaagaaaaaaaacagaaaatgaatatctatctgatctctaaaaactttttaatttaaataaatgcaagtaatcacaaaataaaatatcagcagatataagtacatagaagtgtctgttcctgaaacacagaaatcttaagtgaaattaagaggcaaaaaattgaaaaacatctgcaacaaataagacagtcttgatattcttaatgtacatattttttgctttaaaaatcatttttgtctgggtgtggtggctcatgcctgtaatctcagcactttggtaggccaaggtgggtggatcatttgaggtcaggagttcaagatcagcctggccaacatggtgaaacccgtctctactacaaaatacaaaaattcgctgggaggttgaggcaggagaatcgcttgaacccaggaagtgtaggttgcagtgagccaagatcacgtccctgcactccagcctgggcgacagagcgagactctgtctcaaaaaaaaaaaaaaaaaaaaaaacatttaaaattattttaaacacttttataacatttcatttttcttaaaattttaactagaagattttgtgattttataagaaaaaataattttacgaacaataaatggcaagatttattcatgaaaactgggtgattttgtggaggtgacaaaatttaaacttattcttgacttgaatggcaaaacttctaagtaaggaatcttatttaaatagagccattcatcaaaattgcttactgtgaatataagtatttttaaatgcatgtaaatagaaagaaaagggaatcaggggtagtggatgtaagcaacgggatagtagacgtaaagcaaaagtaagcaaaggcataatagatgtaagcaattaattgttgataaatacaactggtattgaaaataatctggcctcatttgtaattaaatgaaattcaaattttaaaaaattccaatcttgtatcttatattagcaaatctatcctggttcctgtatcataatgacaggtaagtcaatgatgttcactcattcccttttctgccaataatgatagttattagattctgtcctgagcaaatgcaaataaaaatgtatgtgtcaagatatttggaatagaattaattataagatatagaacgtaattatcattaatgtcttatattagaaaataaattgcagcattcatccttatgttgaaatgttgtctaccaattaaactattttttagaaagaattgttaatgataatgaaaataggagtgaaaataccaagatgtgaaattattggctatgtattcttaactatgaatcattaagtcattcacagacaaaagcctaaaaagaaatatgggtatgattatgattattatattcttcatttttttgtgttattccaaatgtattactctgcattccaatacaagttatttttatatgaattgccttatagcaatacaaaatatgctctgtataaaattcttttgctatgaccatcaaatttagagttggtatattataaaaatatttttaaacgtttgtgtaagtaaattcctttgttttgggcttgtaaaagaatgaatttcatgaatgtattaactacttggttagttgaagaattccaacaattcctcatcttacttttaaaaagtgtggtttgtacttagacatgcttatcattaaaaacaaaattcctgttttactcttatctgctaacgctggagaatacaatgtgaaggagatagaaaactctagaattaccttttcaaaatgacagaattcattgttttaaaaatgttattttataaaacacttcattgggtggatactgtttaaatgctaatatattgccaaatatcaattgttgaccttactctttttggtcattttaaaatttgtgttaattatataaaccaaaatattgaacagttttatctccgtatagtcagtcggaaggcagttttgtttagtttgtatgttgtatcatggattttcagtatgttgggacagttctctaaaatgccattatccagaatgattttaaataatattcaattttctgactgacgaaaacattcagaataaatgacagaaaggtcttaaaacatatacttttcttataaagtcttataacaccatctttaaatagcattttaaaataaaggcaatataaaaagtaattcttaaaaaaataaaataaagagttcgaaagatatcatgttagagtttcaaatggtgagtcctgtttcctttgagccactgctgctccagaagcctataaatattattgtttatacaagtggagtatccctaatccaaaactccaaaattcgaagtactcaaaaatgtgaagctt

SEQ ID NO: 74 - DNA, 16 bp, artificial sequence
  TWIST forward primer
gtagcgcggcgaacgt

SEQ ID NO: 75 - DNA, 23 bp, artificial sequence
  TWIST reverse primer
aaacgcaacgaatcataaccaac

SEQ ID NO: 76 - DNA, 24 bp, artificial sequence
  TWIST probe oligo (6FAM--BHQ-1 format)
ccaacgcacccaatcgctaaacga

SEQ ID NO: 77 - DNA, 1327 bp, Homo sapiens
agtcaagaatagaaaaaaattatggctttgaagtatgagttatttaaagaaagtggaaacatcctcagactatgcagtaaaaaacaaagtgattttcttcttctaaacttatgcaataaactgataggtaatatgtgaaagtcatagaatgtagactagaggatacaacaaacctatttcctctatgttcataagaagtaagaaaagctctgatgtgagttagcattgctttacaattttgaattgtgcagattgcacgtacttttcctcagtttgaagtaaatagtggacaggaaaaaatattaaatgttggcagtaaatatggaaggaaattacaactaatgtaatatgctaaaacatgctatgtttattttactaatttgaattaaaatgtaagaatttaaaatgccctggaaaaacacgggcattgatctgacgtctgaagttttaaaatattacacactttgaaatagcatttgtaccttgaaatacctgtctctatatattttttaaaacttcctttttctttcattccatttatcatcaaataaaggatgaacagatgtaactcagaaactgtcaagcatgctgaagaaagaccactgcagaaaaatttctcctagccttttcaaaggtgttaggaagcagaaaggtgatacagaattggagaggtcggagtttttgtattaactgtattaaatgcgaatcccgagaaaatttcccttaactacgtcctgtagttatatggatatgaagacttatgtgaactttgaaagacgtgtctacataagttgaaatgtccccaatgattcagctgatgcgcgtttctctacttgccctttctagagaggtgcaacggaagccagaacattcctcctggaaattcaacctgtttcgcagtttctcgaggaatcagcattcagtcaatccgggccgggagcagtcatctgtggtgaggctgattggctgggcaggaacagcgccggggcgtgggctgagcacagccgcttcgctctctttgccacaggaagcctgagctcattcgagtagcggctcttccaagctcaaagaagcagaggccgctgttcgtttcctttaggtctttccactaaagtcggagtatcttcttccaagatttcacgtcttggtggccgttccaaggagcgcgaggtaggggcacgcaaagctgggagctactatgggacagttcccaagtgtcaggctttcagatttcctgaacttggtcttcacgggagaagggcttcttgaggcgtggatagtgtgaagtcctctggcaagtccatggggaccaagtggggttagatct

SEQ ID NO: 78 - DNA, 22 bp, artificial sequence
  ABCB1 forward primer
tcgggtcgggagtagttatttg

SEQ ID NO: 79 - DNA, 21 bp, artificial sequence
  ABCB1 reverse primer
cgactatactcaacccacgcc

SEQ ID NO: 80 - DNA, 30 bp, artificial sequence
  ABCB1 probe oligo (6FAM--BHQ-1 format)
acgctattcctacccaaccaatcaacctca

SEQ ID NO: 81 - DNA, 117143 bp, Homo sapiens
acggggtctcgaaaaaaggagaatgggatgagaaggatatatgggtagtgtcattttttaacttgcagatttcatcctagtcttccagttatcgtttcctagcactccatgttcccaagatagtgtcaccaccccaaggactctctctcattttctttgcctgggccctctttctactgaggagtcgtggccttccatcagtagaagccggatgttcttgtgtccgaaattggtgggttcttggtctcactgacttcaagaatgaagttgcggaccctcacggtgagtggtacagttcttaaagatgatgtgtccagagtttgttccttctgatgttcggacgtgttcagagttacctccttctggtggattcgtggtctcgctggcttcaggagtgaagctgcagacctttgcggtgagtgttacagctcttaaggcggcatgtctggagtttgttcgttcctcccgtctggagttgttcattcctcctggtgggttcgtggtctcgctggcttcaggagtgaagctgcagacctctgcggtcggtgttaccagcagataaatgctatgcggacccaaagagtgagcagcagcaagatttattgcaaagagcacaagaacaaagcttccacagcgtggaaggagaccagagcgggttgctgctgctggctcaggcagcctgcatttttttttttttttttttttttttttgagatggagtctccctctgtcacccaggctggaatgcagtggtgcaatctgggctcactgcaagctccgcctcccgggttcacgccattctcctgcctcaacctccccagtagaggggattacaggcacccaccaccgcacccagctaatattttgtctttttagtagagtcggggtttcactgtgttagccaggatggtctcgatctcttgacctcgtgatccacccctctaggcctcccaaattgctgggattacaggtgtgagccactggcacccagcggggcagcctgcttttattcccttatctgaccccacccacatcctgttgattggtccattttacagagagctaattggtccgttttgacagggtgctgattggtgcatttacaatccctgagctagatatacacagagtgctgattggtgcatttacaatcctctagctagacataaaaattctccaagtccccactacatttgctagacacagagcactgattggtgcgtttacaaacctttagctagacacagagtgctgattggtgcatttgcaaaccttgagctagacacagagcactgattggtgcatttacaatcctttagctagacacagaagttctccaagtgcccaccagattagctagatacagagtgctgattggtgcatccccaaaccccaagctagacacagagtgctgactggtgcatataaaatcctcaggctagacataaaagttttccaagtccccatctgactcaggagcccagctggcttcacctagtggatcctgcgcagggctgtgccgggcgcctgcactcctctcagcccttgggcagtcgatgggaccgggcgctgaggagcagggggcggtgcccgtcggggaggctcaggccacgctggagctcacaggggttgggagggggctcgggcatggcgggctgcaggtcctgagccttgccctgtgcagggcggctggggcccggtgagaattcaagcggggtgcaggcgggccggcagtgctgggggacccggcgcaccctctgcagctgctggcccgggtgctaggcccctgactgcccggggccgggggtgcggggcccgctgagcccgcgcccacctggaactcgcgctggctggcgagcgctgcgcgcagccccagttcccacacccgcctctccctccacacttccccgcaagcagagggagccggctctggcttcggccagcccagagaggggcccccacagcgcagtggcgggctgaagggctcctccagcacggccagaatggacgccaaggccgaggaggcgccgagagcgagcgagggctgctagcacgttgtcacctcgcattctgaaccacagactctccaactctccggcgcttttcgcccactcggtccctcagaacacgaagggctctctcatcctgtcactaaaacgattagctgtccggagacacggaaaaagtcgcccctcttctttgcaggattcctcccttgaacttctccaaaccctcttagtgtgacgtgaccccacccctagctaacccaggctgcttccttaccagcttcccgccccctggggaggcggcaatgcaaagaccgtccgctgccagctctgccgctatctctgtggggtgaatctaacatggcggacaaagacagtaactagtcccgtttctccgcgttttcgccaagaagattggctcttaccacttgtccctcaaaacgaccaccccattgactggtggcgattgcgtcgacggagacggggcaaaagcaagctgaacccgaaaaataacaaacactggggctgaggggtggaactacgagtgcgcagacatgggccagagcgcatttcccctgccccaggcaaattcggcgctcactgcgtccccgcaggccactgaccttacaagactacttgccccagactcctggggctggatgggaattgtagtctccctaaagagttgtacgtatctttttaaggcctagtttctgctttcaaaatacgaaaacataacactccagtccataactgttgacaagtacaagcgcgcacaggtctccaatctatccactggatttccgtgagaattgtgcccgctctggtattggatgttcctctccataagactacagtttctaaggaacactgtggcgaagacctttcattccgcaacgcatgctggaaataattatttccctccacccccccaacaatccttattacttatatttaccgaaactggagacctccattagggcggaaagagtgggggattgggacctcttcttacgactgctttggacaataggtagcgattctgaccttcgtacagcaattactgtgatgcaataagccgcaactggaagagtagaggctagagggcaggcactttatggcaaactcaggtagaattcttcctcttccgtctctttccttttacgtcatccgggggcagactgggtggccaatccagagccccgagagacgcttggctctttctgtccctcccatcctctgattgtaccttgatttcgtattctgagaggctgctgcttagcggtagccccttggtttccgtggcaacggaaaagcgcgggaattacagataaattaaaactgcgactgcgcggcgtgagctcgctgagacttcctggacgggggacaggctgtggggtttctcagataactgggcccctgcgctcaggaggccttcaccctctgctctgggtaaaggtagtagagtcccgggaaagggacagggggcccaagtgatgctctggggtactggcgtgggagagtggatttccgaagctgacagatgggtattctttgacggggggtaggggcggaacctgagaggcgtaaggcgttgtgaaccctggggaggggggcagtttgtaggtcgcgagggaagcgctgaggatcaggaagggggcactgagtgtccgtgggggaatcctcgtgataggaactggaatatgccttgagggggacactatgtctttaaaaacgtcggctggtcatgaggtcaggagttccagaccagcctgaccaacgtggtgaaactccgtctctactaaaaatacaaaaattagccgggcgtggtgccgctccagctactcaggaggctgaggcaggagaatcgctagaacccgggaggcggaggttgcagtgagccgagatcgcgccattgcactccagcctgggcgacagagcgagactgtctcaaaacaaaacaaaacaaaacaaaacaaaaaacaccggctggtatgtatgagaggatgggaccttgtggaagaagaggtgccaggaatatgtctgggaaggggaggagacaggattttgtgggagggagaacttaagaactggatccatttgcgccattgagaaagcgcaagagggaagtagaggagcgtcagtagtaacagatgctgccggcagggatgtgcttgaggaggatccagagatgagagcaggtcactgggaaaggttaggggcggggaggccttgattggtgttggtttggtcgttgttgattttggttttatgcaagaaaaagaaaacaaccagaaacattggagaaagctaaggctaccaccacctacccggtcagtcactcctctgtagctttctctttcttggagaaaggaaaagacccaaggggttggcagcaatatgtgaaaaaattcagaatttatgttgtctaattacaaaaagcaacttctagaatctttaaaaataaaggacgttgtcattagttctttggtttgtattattctaaaaccttccaaatcttaaatttactttattttaaaatgataaaatgaagttgtcattttataaaccttttaaaaagatatatatatatgtttttctaatgtgttaaagttcattggaacagaaagaaatggatttatctgctcttcgcgttgaagaagtacaaaatgtcattaatgctatgcagaaaatcttagagtgtcccatctggtaagtcagcacaagagtgtattaatttgggattcctatgattatctcctatgcaaatgaacagaattgaccttacatactagggaagaaaagacatgtctagtaagattaggctattgtaattgctgatttccttaactgaagaactttaaaaatatagaaaatgattccttgttctccatccactctgcctctcccactcctctccttttcaacacaaatcctgtggtccgggaaagacagggactctgtcttgattggttctgcactggggcaggaatctagtttagattaactggcattttggcttttcttccagctctaaaacaagctccatcacttgaaatggcaaaataaaatcatggatgaggccgagggcggtggcttatgcctgtaatcccagcactttgggaggccaaggtggtaggatcacgaggtcaggagatcgagaccatcctggccaacatggtgaaaccccctctccactaaaaatacaaaaattagctgggcgtagtggcatgtgcctgtaatcccagctactcaggaggctgaggcaggagaatcacttgaaccaggaggcagatgttgctgtgagccaatatggcaccactgaactccagcgacagagctaaactccatcccaaaaaaaaaaaaaaaaaaaaaaaaacatggatgatcggtgtcgttgagaggataggtatttggaagaacctttgtttgaaactggctctgtacatacaatgaaattacatacttatttacatacaatgaaatgcagaggttttttttttatataggatctctgtcgagaggctggagtgcagtggtgctatcacagctcactgcagcctcaacctcgtcaggctcaagcaatcctcccacctcagcctccagagtagcagggacgataggtgtgcaccaccatgcccagctaatttttgtatttttttttctttttttgagatggagtcttgctctgttgcccaggctggagtgcagtggcgcgatctcagctcactgcaaactctgcctcccgggttcatgccattcttctgcctgagcctcctgaatagctgggactacaagcacccactaccacgcccggctaattttttgtatttttttttcttttttagtagaggcgggatttcaccgtgttagccaggatagtcttgatctcctgaccttgtgatccacccgcctgggcctcccaaagtgctaggattacaggcataagccactgcgtccagccattcttgtatttttctgttgtagagatagggttttgctatgttggccatgctggtctcaaactcctgacctcaagtgatctaccctcccttggcctctcaaggtgctgggattacaggcctgagccattgcacccagccatggtctaaaaatcttgattgaaataccaccttttcatttccagacacccctatttaaaattaccacacccccagcacacactttatcttctattcctgctgcttctccataacactgattactagctgacattctatgtaatgtatccattttttatctctagtcccacagaatgtaaactccaggatgggatttttgttttgtttacatacatctgtatgttcagtagttagaacggtacttgggacctagttgccactcaataaacatttgtcaaataaataataaactaaactaaattagttctttaatttttttaaatatggtgatggttagtagtgagtaacattcaaaaaataagttgaaaagttgtaccattgcctcttacccacaataaaaaagggtaaattcttttctgctttatgaaagttgtttttcatatttgaagtcaagttaatcagattaaggaaaatgtatgttgtgttttcagagcgatacaagatttataaataaccatcctctcccttgcccttcaacattatagctaaacaaaaataagaggaaaacaggattcacaatttatcaatttattgaaaatcagagccagagaagcaggaaatgacattgtaggaaaaaactgcttttgaaaaagcacaaaacttactcatgacaatcagtgatcaggaaaatcctcaatagtgtggcatttggatacatttatgtttcatttccatgggagagagtcataaaaataggatgttctttctcattctggcaaattaaaccatcaattaaaaactcagatacataaaaattaaagatgtaagaatgaaaatgctaaattgttattttcaatcaactattatgttttctagcttttcattgcttttttctgtttcctgttaagattaatttctttttttttttttttttttttttttgagacagactttggctcttgttgcccaggctggagtgcagtggcacaatctcggctcactacaacctccacctcccgggttcaagcaattctgctgcctcagcctccggagtacctgggattgcaggcatgtgccatcacaccagctaattttgtatttttagtagagacagggtttctccatattggtcaggttggtctcgaactcctgacctcaggtgatcctcctgccttggcctccgaaagtgctgggattacaggcgtgagccaccgctcccagactttttgttttgttttgttttgtttttttgagacacggtctcgctctgctgcctaggctggagtgcagtggcacgatcttggctcactgccagctccgactcccgggttcaggccattctcctgcctcagcctcccgagtagctgggactacaggcgcccaccactatgcccggctaattttttgtatttttagtagagacggggtttcaccatgttagccaagatggtctcgatctcctgaccttgtgatccacccgcctcagccttccaaagtgctgggattacagtcctgagccactgcgcccggcctggacctttttttttcggggtggggggttggagtctggctctgtcgcccaggctggagtgcagtggcgccatcttggctcactgcaacctccgcctgccaggttcaagttcaagcgcttctcctgcctcagcctcctgagtagctgggattataggcgcacgccaccgtggccggctaattttgtatttttagtagagatagggtttcatcacgttggtcaggctggtcttgaagtcctgatctcgtgatccacccgcctcggccttccaaagtgctggcgtgagccactgcgcctggcttaagattaatttttgtttgttttgtttttgagacggagtctcgctctttcacccaggccggagtgcagtggcgccatctcggctcactgcaagctccgcctcccgggttcacgccattctcctgcctcggccccccaagtagctgggactacaggcgtccaccaccacgcccggctaattttttgtatttttagtagagacggggtttcaccgtgttagccaggatggtctccacttcctgacctcgtgatccgcccacctcggcctcccaaagtgctgggattacaggcgtgagccaccgcgcccggccttaagattaatttttatggtgttttacattcatttgtatggaaagttctaggatagggatcatatttcacttccttttaatatagtacagtatagcacaatttgcagttatgtcttaatatgtgatcaggaatgatcatgactggaaacagtgttatttgtggtagctatagggtaggtaaggttttcagcctgttttaggtttcttgaactaaaattccttctgctgtcttctaagtcaatattggcagctatttctgacaattggtagttctttgtaactttttacctatgactataacatttttgactttcagaagaatttgctaaaatgtgttccccggtgggttgttgtttttcaacctaaacctagctgctttttccagtcacttatccgtattggaagctcaaaatgcaaatatacagtaggcctaaaatattgcctggtttgaaaagtgtttaaaatatttgaatcatttttatagtaaacatttactctcatcaggacctagaaggggaacattttaattttttttcttttcccttttcacagtcttccttcaacattcattacctttttacatatcggagttttcatctgttcaaagtttgtgtttacagtgtgtttatatagtttagattataattaccatactgaaatataattgtttcagaattgagtcagtggtgagaatgaaagccatctggtatgataactgaatccaatttttcttttacggagaatttctttgaaatgtagcttatctcagaaatagggatttagtaaccaatcagagttttctttgtcaaggttgtttttctttttaaagtcacatttggtcccagtaataataccaatgttggtacaagttatctcaggttgtgaagcatttttcccaagtcatctcaggttgtgaagcattttcccaagtagcatttaattttattcttgcaatagcccaaggagtctggcagggtgaatggcaagagaaggaaacaggttcaggtagagtggttagcccaaggtggctctgcttatatacacaactggtagtagaaacccagcctcctgacttagttcattgtttttcttttcactgccctgtgctatgtcaaaaaccccatgattacaagagttgtattacaacccttcacaataaggttactgtccacaagcttttcttgtgatccttttcttttttttttttctttttttgagatggattctctgtcacccaggctggcccgccttggcctcccaaaatgctgggattacagcgtgagccaccgcacctggcccttgtgatccttttctaaaaagttaaatatttaaggaaaaaaccacattcttgtcacactgccaggttagtcgttctttgatatcttgcctggactttatccaaaaaatccgtttcaaaaattcacatttagagctaagtgtagtggctcacgcctgtaatcccggtcgaggcagatggatcacttgaggtcaggacttcaagaccagcctgggcaatatggtgaaaccccttccctaccaaaaatacaaaaaaattagccgggtgtggcagcacgcgcctgtagtcccagctacttggaatgctgaggcacaagaatcacttcaatccgagaggcagaggttgcagtgagccaagaccacaccactgcactccagcctgagcagcagagtgagtgagactccatctccaaaaaaaaaaaaaaaggttcacattcagaagaaagctaaaggccgggtatagtagctcacacctgtaatcccagcactttgggaagccgaagcaggaagattgcttgatgccaggcattcaagaccagcatgggcatcatagtgagatcctgtctctacaaaaattaattaacattaaaaattaaaaagatggctggcatggtggctcactcctgtaatcccagtactttgggaggccaaggcatggtggtgcatgcctttagtcccagctactcgggaggctgaggcaggagaatcacttgaattcaggaggcggaggttacagagagccgagatggtgccactgcactccagcctgggcgacagaacgagactctgtctgaaaaaaaaaaagaaaattaaaaagaccagaataaagctaaagatttaaaatagcctataggttcctaccagaagttaccagctacctctctgatagtctttccctacaatatcctcctggattattacattttagcaccttgacctatctgatgtcctgcatacacaggcatggtcctgctcagggtttgccttctctgctccctctttcttggaatgctcttcccctaattgttgcatagtgtgtttctttacattattaagctatcctctagtctcacctcagtgaaacctttcctgactccccccatgtacatctcacccccacatagatattgaactacctgtttccccttaccctgcttaatttttctctttaatgcacttattcccatgtattctttaattccgtatcaactgtctaccacactagaatatgagctctatgagagcaggctttattttgtaaactgctacatttctatctcctagaatagtacttgaatatagtagtagatacttaataaacacttgttatattagtataataaatgaactaatctcaggaatgccttggttttgtggatagacaggtagggatgggaacttgggtgatgtattttctgaagtttttatttttaagcttattattattttgagatggagtccagctctgtcgcccaggttggagtacagtggcgcgatcttggctcactgcaacgtgcacttccccggttcaagcgattctcctgccttagcctcccaagtagctgggattacaggcgcatgccaccatgcccagttagttttggtatttttagtagagacagcgtttcactgtgttggccaggctggtctcgaaatcctgacctcatgatccgcccgcctcggcctcccaagtgctgggattacaagcatgagcccccgtgtctggccttattttcttttttttgagacagagtcttcctctgtcacctaggctggagtgcagtggcacgatattggctcactctgcaacctccacctccaggattcaagtgatccttctaccttagtctccaaagtagctgagaccacaggcatgccccaccacgcccggctaatttccgtattttaagcgtagacagggtttcaccatattgtccaggatgatctggaactcctgagctcaggtgatccacccacctcagcctcccaaagtgctaggattacaggcatgaggcaccatgcccggccttaagcttatcattttctaaatttcctttagtgagtacttattacactgtttttacaaagtaatcacaaaccaaacatcatgcctcttctgaagtgatctaataagagtacacagtaccatctgtaaagtgttcttgccagaaagttgaacctgaatgattaagcctgtaagtctagtttataggaaataaggctagaggaacaagttaaacctcaccatagggttatacaatcagcaaaatccagaatgggggaaactccacaggtcaaatgacctaattttaaaaataaatgacaagggagaaaaagtaagagacacctatagatcagaagacacttggggctgggcatggtggctcacacctgtaatcccagcactttgggaggccaaggcaggcggatcacctgaggtcaggagttcaagaccagccggccaacatggtgaaccccaactctactaaaattacgaaaaatcagccgggcgtggtggcgcacgcgtgtagttccaactacctgggaggctgaggcaggagaatcacttgaacttgggaggcagaggttgcagtgagccgagatcgcaccattgcatgccagtctgggctacaaaagcaaaaccccatctcaaaaaaaagaagacacttgggtttgggtgtgttggctcatgcctgtaaaccccgtgctgggaggattgcttgagcccaggagttcaaggctgcagtgaggtatgtttgcaccactgcactccagcctaggtgacagagtgtgaccttatcttaaaagtaataataattaaaataatctggggtaggggtggatatgggtgaaacagcttggccatgagttgatggttgttggaccagggtgatggtccatatagttcattttattattttatttacttgaaattttgaaatacttgaaattttccatattaagttaaaaaggcatttacagtaaacaaaaaaaagttctaggaaggaattcaaaagaaatataagcagaaaattttgtctttatggagcttaaagatgagatgtgcacccacagtgatagtgcagaaaaatatatcactggaaatgaattcgtacgaactattatcaactaatcttttaaatgctgatgatagtatagagtattgaagggatcaatataattctgttttgatatctgaaagctcactgaaggtaaggatcgtattctctgctgtattctcagttcctgacacagcagacatttaataaatattgaacgaacttgaggccttatgttgactcagtcataacagctcaaagttgaacttattcactaagaatagctttatttttaaataaattattgagcctcatttattttctttttctccccccctaccctgctagtctggagttgatcaaggaacctgtctccacaaagtgtgaccacatattttgcaagtaagtttgaatgtgttatgtggctccattattagcttttgtttttgtccttcataacccaggaaacacctaactttatagaagctttactttcttcaattaagtgagaacgaaaaatccaactccatttcattctttctcagagagtatatagttatcaaaagttggttgtaatcatagttcctggtaaagttttgacatatattatctttttttttttttttgagacaaagtctcgctctgtcgcccaggctggagtgcagtggcatgatcttggctcactgcaacctccgccccccgagttcaagcgattcttctacctcagcctcccaggtagctgggactacaggcacccgccaccatgcttggctaatttttgtacttttagtagagataaggtttcaccatattggccaggctggtctcgaactcctgaccttgtgatccacctgcctcggcctcccaaagttctgggattacaggcgtgagccaccacacccgactgacatatattatctattaggatgtaacatcattttgaacagtgttttgtattttttgtgtccatcagtgaaagcaaactgcaagcagttttgaaataagcacattgtgtttgagccttcccagtttctcctttctgttcatttctgcatatccttatgcattcccccttctaagggtcagtgtttgcccgctttgtaatcattgtgaagacaggaaaggacctgataccagtttctatttaggccaaaattcatttatagcagtgattcaagttatatttacgtatttgatgatcttgtcttttgaaatgaaaatgtttgtttcttaataaaagaatttcagaaaaagtagagtaggtaatttagtagaacaagtgggctttctccttttctttatgttaagctatggctcacatcttaccttaaatgtcaactaatttgtttttaagtatttatgtacctggtacataacctggtaccaggtacaaactatgtacttggtaaaaagtttattagcacaaaaaggtatatgatgcaaagtatacttccctcttaccctacaacccctgcctccctgttccctccccagacaaccacaatgatcaatttcttatgtatcctttgaggaatttttaaattccagagttcttaacttggggtttatgaatagtctttatgaatttcctagaattatatttaaattgtattcaaaactatggccatgtacatttttctgggaagatagtccataattttcatctgagtgagctaagatcatgccactgcactccagcctgggagacaagagggagactcaaaaaaaaaaaagaaaggcccagtatttactacagagagctaaagattaacctttaaagccctggggctttcaatttatctggatgagaatctttctggaatgaactgtatgttttatggtcagcttgagtaacaaatgctgagcatactatactattattacagggactcaggggcccagtgtggtagctcctgcccataaccccagcactttgggaggccaaggcaggaggatcacttaaggccaggagttcgaagctgtagtgagctatgatcacaccactgcactccagcctagatgacagagtgagaccctgtctttttttttttttgagatggtgtttcactctattgcccaggctggagtgcagtggtgtgatctcggctcactgcaacctccacctcctgggttcaagcgattctcctgcctcagcctcttgagtagctgggattacaggcatctgccaccacacccagctaatttttgtatttttagtcgagacagggttttcaccatgttggccaggctgctctcaaactcctgacttcagctaccttggccttaaaaagtgttgggattacaggtgtaagccaccgcgcctggctgaccctgtctcttaacaaaaaaagagagattaagttatgaatatagttgctttgagaacttgtggaagaaggaaattataggcttataggcagagataataatacgagcaaatgtacaaataaaagaaaatagaggacgggcgcggtggctcacgcctataataccagcactttgggaggtcgaggtgggcggatcacgaggtcaggaaattaagaccatcctggccaaaatggcgaaacactgtctctactaaaacacacaaaaaactagcctggcatggtggcacgtacctgtagtcccagctacttggtaggctgcggcaggggtatcacttgaacctgggaggcagaggttgccctgagccgagatcatgccaatgcactccagcctgacaacagagtgagactctgtctgaaaaaaaagaaaagaaaagaaaatacatccaggaaaaataagctaactttgcatatgtgtataggagttgtgttagaaaaggaagaagccctcaaagatgggaagccatttgcaagaaagagaaggtccaagaggaggcagaagggattggaaatagaaaaaggatgtaagaaagagttgattattactcataaacagtaatgaaggaaaaggagagtaattctacaggaagatgctgaggtgctttgagcccagtgaagttggaggtaaagacagctgttgaggccgggcacggtggctcacgcctctaatcctagcacttttggagcccaaggcaggtggatcacctgaggtcaggagctcaagaccagcctgaccaacatagagaaaccccatctctactaaaaatacaaaattagacgggcgtggaggcgcatgcctgtaatcccagctacttgggaggctgaggcaggagaatcacttgaacctgggaggcggaggttgcagtgagccgagattgcgccattgcactccagcctggccgacaagagtgaaaactgtctcaaaaaaaaaaaacaacaaaaaacagctgttgagattgagaggattagagttggcaactggagaagagtgagaagcttggtttcaagcttgtgatagtcaggattgtgatagtcaggaaagaaccagtcataaagatatatgtgtgtgtatacatataaatatgttatatatatgtgtgtgtgtgacacatatatatttttgtttgtttctttgagacagtgtctccctctgacacccaggctggagttcagtggtgtgatcatagttcacttttaccttgcaatctgggttcaagcaatctctcatctcagcccctcaagtagctaggactacaggtacatggcatttgcccagctaatttttaagtttcttgtagagatgggccagccatattttaaattgtgttttgaatgttatattagaattaaaagtccaaagccgggtgtggtggctcacgcctgtaatcccagcactttgggaggctgaggtgggcggatcacgaggtcaggagttcgagaccagcctggccaatatggtaacaccatctctactaaaaatacaaaaattagctgggtatgggggcacatgcctgtagtcccagctactcaggaggctgaggcagaggaacctcttgaacccaggaggcagaggctgcagtgagttgagatcgtgccactgtactctagcctgggcgacagagcaagattccgtctcaaaaaaaaaaaaagtccagtataatgcccatgtgatagatcgactttttcatgaaatctcttctgtaatatcaatataatctgaataacactttgatctatatgatgagaaagctgggagcctgggagcgatacccccatgcttttgttgtattaattgtattttctacggataaactctaattgctaaaaataaaacaactttattgacccaagcaagcctaaagttctgaaatcttttttttatttttgtttgtttgtttgtttgtttttgtttgttttgttttgagacggagtctcgctctgtcgcccaggctggagtgcggtggtgcagtctcggctcactgcaagctccacctcccgggttcacaccattctcctgcctcagcctcccaagtagctgggactacagacgcctgccaccacgcccagctaatttttttgtatttttagtagagaaagggtttcaccgtgttagccaggatggtctcgatctcctgacctcgtgatctgcccgccttggcctccctaagttctgggattacaagtgtgagccaccacgcccggctgtttttttttgttttgttttgagacggagtctcactgtgttgcccagactggagtgcagtggcatgatctcagctcactgccacctccatctcctgggttcaagcaaatctcctgcctcagcctcccgagtagctgggactacaggcatgtgccaccacacctggctaatttttgtatttttagtagagacggggtttcactatgttggccaggctggtccaaaactcctgacctcaggtgatctgctcgccttggcctcccacagtgccaggattacaggcatgagccaccttgcccagccagttctgaaatcttttatgaagcctataaaaaaagataataataccaatctagaaaatatttcttaaggcagtcatgcattagtttgaactttccaaacaaaaaaatgcaatgtgtaatacttttttttttttttttgagatggagtcttgttctgttgcccaggctggagtgcagtggtacaatctcggctcactgcagcctctgcctctctggttcaagtgattctcctgcctcagcctcccaagtagctgggattacaggcgtgcaccaccatgcatggctaatttttgtatttttagtagagacagggtttcaccatgttgacaaggctgatctcgaactcctgacctcaggtgatccgcccacctcagcctcccaaagtgctgagattacaggcattagccaccacgcccagccttttattttagtagagaccatgtttcaccatgttgaccaagctggtcttgagctgacctcaagtgatccgcccacctccacctcccaaaatggtgggattataggcatgagccaccgcacccagcctgtaatacttttttgaagatctagaaccacattgttcaaagagatagaatgtgagcaataaatgtaacttaaatttttcaacagctactttttttttttttttttgagacagggtcttactctgttgtcccagctggagtacagtggtgcgatcatgaggcttactgttgccttgacctcctaggctcaagcgatcctatcacctcagtctcccaagtagctgggactgtaagtgcacaccaccatatccagctaaattttgtgttttctgtagagacggggtttcgccatgtttcccaggctggtcttgaactttgggcttaacccgtctgcccacctaggcatcccaaagtgctaggattacaggtgtgagtcatcatgcctggccagtattttagttagctctgtcttttcaagtcatatacaagttcattttcttttaagtttagttaacaacctttatacatgtattctttttctagcataaagaaagattcgaggccgggtgcggtggctcacgcctgtaatcccagcactttgggaggctgagatgggcacatcacgaggtcaggagatcgagaccatcctggctaacatggtgaaaccccgcctctactaaaattacaaaaagttagccaggcgtggtagcgggcacctgtagtcccagctactcaggaggctgaggcaggagaatggcgtgaacccaggaggcagagcttgcagtgagcagagattgtgccactgcactccagcctgagagacagagcgagactccgtctaaaaaaaaaaaaaaagattcgaatccttatcttggttgatttttgcgtatctagttccactgaattatttatataattgtatagactacagcacgagacagcttagcttgtcactctactgtactatattctgcagtactatcataagggaatttcctccctacccctgctctgaattgttcaattgtactatttgctggagtaatgcttgatgccttcttgatccattatactagagtatatgtagtatttgtagattctgaaggagtgggagcctctattctgagttttaaaggtacttatgtacagtggaggtagctttttgacagcctcatcttccaaactatagagtcattgttttgttgagtgcaatatggtacttgaagcatctatatcggcgaagaaggacccaagtctccttgaccttacctacctacattcactttctctggtaggaagattgtgggtgcctctctccagacttagtttccatgtcaaaaaagaaaaaaggaagattgtgggctttgctacaatccaattctggatccaatataaccttcattgcttaattactgtgtgatctgggacaagcctctactctataaaaatgaagataaggccaggcttgatggctcatgcctgtaatcccagcacgttgggatgccaaggcaggaggatcacttgaggtcaggagttcgagaccagactgggcaatatagtgaaaccacatctgtacaaaaataaagatagaaagtagcccagcgcaatggctcacacctgtaatcccagcactttgggaggctgaagcaggcgatcacttgaggtcgggagttcaagactgtagacagatagataggtaggtagatagatagagatatagatatagttggggtttttttgttttgttttgttttgtttttgagatggagtttcgctcttgttgcccaggctggagtgcaatggcgcgatctcagtttactgcaacctccgcctcccgggttcaagagattctcctgcctcagcctcctgagtagccaggattacaggcatatgccaccatgcccggctaatttttgtatttttagtagagacagggtttctccgtgttggtcaggctggtcttgaactcctgacctctcccaaagtgttgggattacaggcgtgagccaccgctcctggccttttttttttttttttttttttttttgagacagagtcttcctctgttgcccagggtggagtgcagtggcactcttctcagctcattgcaacctctgccatcctgggttccagtgattctcatgcctcagcctcccaagtagctgggactcaggcgtgtgcccaccacgcctggctaattttgttgtatttttagtagagacagggtttcaccatgttagccaggctggtctcaaactccaggcctcaagtgatctgcctgcctcagcctcctgggattgcagacatgagccactgcacccggccaagagagggtaataaatgttaaattacctggctagtaaaaaatattctctaagtgtcttttctcacaattcccaatgccttttttttttttttggcacaatctcactctgttgcccaggctggaatgcaatggtgcaatattggctcactgtaacccccgcctcacaggttcaacttattctcatgcctcagcctcccgagtaactgggactacagtgcaccaccaccacacccagctaatttttgaatatttagtagagacagggtttcaccatgttggccaggctggtcttgaactcctggcctcaagtgattcacccaccccgcaagtgctgggattacaggtgtggaccaccgtgcacagccctagtgactttttttttagccccttaatcttttctttcctgggtctcttcattgtcagtgtctgctatttactccctacctagtcacccccttcaccagtatattatgtcctttatgttttattttgcaggatcttattttgcttttctattgaatcccctccatctagaatagtactagacatagtaaatattggttgtatgagtgaatcgctgcttttaattatcatcaccattgctctctctacttctggtctatgatccactttgagttaacttttgttatttggtgtgagataggagtataatttcattcttttacatgtggttatacttttgtctcaacactgtttgttaaaaacacaaaaagtattattttcccatttaatcatctttggcctgggcacggtggctcatgcctgtaatcccagcactctggaaggccaaggcagatggatcaatttgaggccaggagttcaagactagccaacatggtgaaactaaaaatacaaaaaattagctgggtatggtggtgcatgtctgtaatcccagctactcgggaggctgaggcacgagaattgcttgagcctaggaggtggaggttgtagtgagctgagattgtgtcactaccctccagcctgggtgatagagtgagtctgtctcaaaaaaaaaaaaaaaaaattaagaaaataaaaatcgtcggccaggcatggtggctcacacctgtaatcccagcactttgggaggcagaggcgggcagatcacgaggtcaggagatggagaccatcctggctaacatggtgaaaccccgtctctactaaaaataaaaaaattagccgggcatggtgctgggcgcctgtagtcccagctgctcgggaggctgaggcaggagaatggcgtgaacccaggaggtggagcttgcagtgagccgagatcgtgccactgcactccagcctgggagacagagcgagactccgtctcaaaaaaaaaaaaaaaaaaaattgtcttggtatttattattgttgaaaatcgcttgatcacagatgtatgtatgagtttatttctgtactgtcaattccattttattgatgtatgtgtctattcttatgctattaccacactttcttgattactatagctttgtggtgaggtgttgagattttaaactaattataagcatcttacatgaactacttaccgtttatatttgattatgcagcatgaaataattatgaatatatcattaaatatgccatattaacttttattaagttttatgtgatcataacagtaagccatatgcatgtaagttcagttttcatagatcattgcttatgtagtttaggtttttgcttatgcagcatccaaaaacaattaggaaactattgcttgtaattcacctgccattactttttaaatggctcttaagggcagttgtgagattatcttttcatggctatttgccttttgagtattctttctacaaaaggaagtaaattaaattgttctttctttctttataatttatagattttgcatgctgaaacttctcaaccagaagaaagggccttcacagtgtcctttatgtaagaatgatataaccaaaaggtatataatttggtaatgatgctaggttggaagcaaccacagtaggaaaaagtagaaattatttaataacatagcgttcctataaaaccattcatcagaaaaatttataaaagagtttttagcacacagtaaattatttccaaagttattttcctgaaagttttatgggacatctgccttatacaggtattagaaacttactgcctttctctaatgcttctagtgtaaaaacttgcagacttatgtaaagtagggctgtatcgccgtgcccccattgtctgttaatcttgtttttatatttttgattgtgtttccttttctttttttttttttttttaagacagggtcctgctctgtcactgaggctggagtgcagtggcgtgatctcggctcactgtagcctctgtctcccagcctcttcctgccttagcctcccaaatagctgggactacaggcacacgctaccatgcccggccaatttttgtattttttgtagagatgaggttttaccatgttgcccaggctggtaactcctgagctcaggtgatctgcccacctcggcctcccaaagtgctggggttcacaggtgtgtgtttatttctatctaattatttacacaaacacaatgtatttatatattgtgtatctcttctgctacaatgtaaattctatgagagtagtaattttgtctgtctcaacactgtttttcctaagtttggtacatagtaggcactcagatgcttaaaggaatgaatgaattgtgctttaattccactttactaaacccaaatctccctttggacattgttatctatgtgttttcaaagaagtataatcataatttgacagaaatccttgagaggcagaactaagtgagggattgggcagggttcagatgttaagaacagtaagctcagcagggtgtgattgctcatgcctataaccctagcactctaggaggctgaggtgggatgattgcttgaggccaggagtttgaaatcagcctgggcaacatagtgagaccccatcactaccaacaaaataaataaataaatgtacatggtggcatatgcccatagtcctagctacttgggaggctatagtgggaggatagcttgagtacagaagtctgaggctgcagtgagctatgattgtggcactgcatgctagcctgggcaatagagcaagaccctgtctctaaattaaacaaaaaaaaaagtactctagttttctatgcaatgcattatatctgctgtggatttagggcagtattatatcagataattttaggcatttggtaggcttaaatgaatgacaaaaagttactaaatcactgccatcacacggtttatacagatgtcaatgatgtattgattatagaggttttctactgttgctgcatcttatttttatttgtttacatgtcttttcttattttagtgtccttaaaaggttgataatcacttgctgagtgtgtttctcaaacaatttaatttcaggagcctacaagaaagtacgagatttagtcaacttgttgaagagctattgaaaatcatttgtgcttttcagcttgacacaggtttggagtgtaagtgttgaatatcccaagaatgcaactcaagtgctgtccatgaaaactcaggaagtttgcacaattactttctatgacgtggtgataagaccttttagtctaggttaattttagttctgtatctgtaatctatttttaaaaaattactcccactggtctcacaccttattttatcaatcgtaaggtgcacatttttcacatcttaacatctctgaaattgggaacattttactattgagggtgtgtcatttgtttaatttgtgtgctttctttcttagtgatacacgaaataatagtgccacttacattgttggtgtcttagctttagtgaaatacagtattgataggcaaatttcttagtgttaaggtagaaaacaaggactctaaataactttgatggtctgtgtatttgtttttgtttcctaggagtaaaatttccagttgattttttaaaatttgatttttaaaaaaaatcacaggtaaccttaatgcattgtcttaacacaacaaagagcatacatagggtttctcttggtttctttgattataattcatacatttttctctaactgcaaacataatgttttcccttgtattttacagatgcaaacagctataattttgcaaaaaaggaaaataactctcctgaacatctaaaagatgaagtttctatcatccaaagtatgggctacagaaaccgtgccaaaagacttctacagagtgaacccgaaaatccttccttggtaaaaccatttgttttcttcttcttcttcttcttcttttcttttttttttcttttttttttttgagatggagtcttgctctgtggcccaggctagaagcagtcctcctgccttagcccccttagtagctgggattacaggcacgcgccaccatgccaggctaatttttgtatttttagtagagacggggtttcatcatgttggccaggctggtctcgaactcctaacctcaggtgatccacccacctcggctccccaaattgctgggattacaggtgtgagccactgtgcccggccggtaaaaccattttcatttattctggcaacatctctttattgagcattgtgaatatgttagtgaatgtgctagatgctcatagatttatataaaaagttagtgaagaaggaaagatggtatattaagtggttagacaagtgttctaatcagttagagttcagagaaggtcagggtacctgatataatcaagagagagaccttacagccaggtgaggtgaatgtacctataatcccagctacttaggaggctgaaatgggaggatcacttgagtccaggtttgagaccagcccaggcaacatagcaagatccccatcagatacaccaaaaagacagatttcttttttttttttttttttgagacagagtctcgctctgtcgcccaggctggagcgcagtgacacgatgtcagctcactgcaacctccgcctcccaggttcaagtgattctcctgcctcagcctcctgagtagttgggactacaggggtacgacaccagacctggctaatttttgtaattttagtagagtcggggtttcaccatattggtcaggctggtctcgaactcctgacctcaggtgatccaccctccttggcctcccagagtgctgggattacaggcgtgagccaccaagcccggccaaaaaagagagctcttataggcccttccttgctttggagctttatctgctctgtgatgcttatctaaaatagccataaggtcactgatatttttaagcatttggaaattacttcagctgggtgccatggctcatgcctataatcccaaccctttgggaggctgaggtaggaggtcctttgagcccagcttgggcaacacagtgagacactgtctctgcaattaaaaaaaaaaaaaaagtagctgggtgccgtggctcacgcctgtaattccagcactaggaggcttgaggattgcctgagctcaggagttcaagaccagtttgggcaacatagcaagtccttgtctatattaaaagtttttttaaattatctgggcatggtggtgtgtgcctgtagtcccagctacttgggaagctgagacagaaggatcacttgagtccaggagatgtagactacagtgagctatgatcactccactgcacttcagcgtgggcggcaaagcaagatctagttgcaaaaaaaaaaagaactggctgggtgcggcggctaacacctgcaatcccagcaccttgggaggctgaggccagtggatcatgaggtcaggagattgagaccaccctggccaacatggtgaaacccggtctctactaaaaatacaaaaattagctgggtgtggtggcacgtgcctgtaatcccagctactccagaggctgaggatggagaatcacttgaacctgagagtcggaggttgcagtgagccgagattgcgccactgcactccagcctggcgacagagcgagactccgtctcaaaaaaaaaaaaaaaaaagcttcacgcctgtaatcccagcactttgggaggccgagtcaagtggatcacgaggtgtggagatcaagactatcctggctcacatggtgaaagcccgtctctactaaaaacacagaaaaattagctgagcgtgatggcggactcctgtagtcccagctactcgggaggctgaggcaggagaatagcatgaacccgggaggtggagcttgcagtgagccgagatcccgccactgcgatccagcctgggcgacagagtgagactctgtctcaaaaaaaaaacaaaaaaacttagctgggcgtggtggtatgcacctgtggtcctagctacttgggaggctgaggctggagcattgctttaacatagagagtcaaggctgcagttgagctatgactgtgccactggactccagcgcaggtgactgagaccctatcttttaaaaaaagggaaaattacttgaacttaaaaggtgtaattgttaaagaaaatgtagtgatttgctctgttgttacttatatgtgcatgaatgatggagatcttaaaaagtaatcattctggggctgggcgtagtagcttgcacctgtaatcccagcacttcgggaggctgaggcaggcagataatttgaggtcaggagtttgagaccagcctggccaacatggtgaaacccatctctactaaaaatacaaaaattagctgggtgtggtggcacgtacctgtaatcccagctactcgggaggcggaggcacaagaattgcttgaacctaggacgcggaggttgcagcgagccaagatcgcgccactgcactccagcctgggccgtagagtgagactctgtctcaaaaaagaaaaaaaagtaattgttctagctgggcgcagtggctcttgcctgtaatcccagcactttgggaggccaaggcgggtggatctcgagtcctagagttcaagaccagcctaggcaatgtggtgaaaccccatcgctacaaaaaatacaaaaattagccaggcatggtggcgtgcgcatgtagtcccagctccttgggaggctgaggtgggaggatcacttgaacccaggagacagaggttgcagtgaaccgagatcacgccaccacgctccagcctgggcaacagaacaagactctgtctaaaaaaatacaaataaaataaaagtagttctcacagtaccagcattcatttttcaaaagatatagagctaaaaaggaaggaaaaaaaaagtaatgttgggcttttaaatactcgttcctatactaaatgttcttaggagtgctggggttttattgtcatcatttatcctttttaaaaatgttattggccaggcacggtggctcatggctgtaatcccagcactttgggaggccgaggcaggcagatcacctgaggtcaggagtgtgagaccagcctggccaacatggcgaaacctgtctctactaaaaatacaaaaattaactaggcgtggtggtgtacgcctgtagtcccagctactcgggaggctgaggcaggagaatcaactgaaccagggaggtggaggttgcagtgtgccgagatcacgccactgcactctagcctggcaacagagcaagattctgtctcaaaaaaaaaaaacatatatacacatatatcccaaagtgctgggattacatatatatatatatatatatatcatatctatatatatatatatgtaatatatatgttatatatatattacatatatatatgttatatatatgttatatatatataatatatatatgttatatatatgttatatatatatatacacacacacacacatatatatgtatatatatatacacacacacacacatattagccaggcatagttgcacacgcttgtagacccagctactcaggaggctgaggcaggagaatctcttgaacttaggaggcggaggttgcagtgagctgagattgcgccactgcactccagcctgggtgacagagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaataattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcggtgaaccgagatcgcaccattgcactccagcctgggcaaaaatagcgaaactccatctaaaaaaaaaaaagagagcaaaagaaagaatatctggttttaaatatgtgtaaatatgttttggaaagatggagagtagcaataaggaaaaacatgatggattgctacagtatttagttccaagataaattgtactagatgaggaagccttttaagaagagctgaattgccaggcgcagtgctcacgcctgtaatcccagcactttggaaggccgaggtgggcggatcacctgaggtcgggagttcaagaccagcctgaccaacatggagaaaccccatctctactaaaaaaaaaaaaaaaaaaattagccggggtggtggcttatgcctgaaatcccagctactcaggaggctgaggcaggagaatcgcttgaacccaggaagcagaggttgcagtgagccaagatcgcaccattgcactccagcctaggcaacaagagtgaaactccatctcaaaaaaaaaaaaaaagagctgaatcttggctgggcaggatggctcgtgcctgtaatcctaacgctttggaagaccgaggcagaaggattggttgagtccacgagtttaagaccagcctggccaacataggggaaccctgtctctatttttaaaataataatacatttttggccggtgcggtggctcatgcctgtaatcccaatactttgggaggctgaggcaggtagatcacctgaggtcagagttcgagaccagcctggataacctggtgaaacccctctttactaaaaatacaaaaaaaaaaaaaaattagctgggtgtggtagcacatgcttgtaatcccagctacttgggaggctgaggcaggagaatcgcttgaaccagggaggcggaggttacaatgagccaacactacaccactgcactccagcctgggcaatagagtgagactgcatctcaaaaaaataataatttttaaaaataataaatttttttaagcttataaaaagaaaagttgaggccagcatagtagctcacatctgtaatctcagcagtggcagaggattgcttgaagccaggagtttgagaccagcctgggcaacatagcaagacctcatctctacaaaaaaatttcttttttaaattagctgggtgtggtggtgtgcatctgtagtcccagctactcaggaggcagaggtgagtggatacattgaacccaggagtttgaggctgtagtgagctatgatcatgccactgcactccaacctgggtgacagagcaagacctccaaaaaaaaaaaaaaaagagctgctgagctcagaattcaaactgggctctcaaattggattttcttttagaatatatttataattaaaaaggatagccatcttttgagctcccaggcaccaccatctatttatcataacacttactgttttccccccttatgatcataaattcctagacaacaggcattgtaaaaatagttatagtagttgatatttaggagcacttaactatattccaggcactattgtgcttttcttgtataactcattagatgcttgtcagacctctgagattgttcctattatacttattttacagatgagaaaattaaggcacagagaagttatgaaatttttccaaggtattaaacctagtaagtggctgagccatgattcaaacctaggaagttagatgtcagagcctgtgctttttttttgtttttgtttttgttttcagtagaaacgggggtctcactttgttggccaggctggtcttgaactcctaacctcaaataatccacccatctcggcctcctcaagtgctgggattacaggtgagagccactgtgcctggcgaagcccatgcctttaaccacttctctgtattacatactagcttaactagcattgtacctgccacagtagatgctcagtaaatatttctagttgaatatctgtttttcaacaagtacatttttttaacccttttaattaagaaaacttttattgatttattttttggggggaaattttttaggatctgattcttctgaagataccgttaataaggcaacttattgcaggtgagtcaaagagaacctttgtctatgaagctggtattttcctatttagttaatattaaggattgatgtttctctctttttaaaaatattttaacttttattttaggttcagggatgtatgtgcagtttgttatataggtaaacacacgacttgggatttggtgtatagatttttttcatcatccgggtactaagcataccccacagttttttgtttgctttctttctgaatttctccctcttcccaccttcctccctcaagtaggctggtgtttctccagactagaatcatggtattggaagaaaccttagagatcatctagtttagttctctcattttatagtggaggaaataccctttttgtttgttggatttagttattagcactgtccaaaggaatttaggataacagtagaactctgcacatgcttgcttctagcagattgttctctaagttcctcatatacagtaatattgacacagcagtaattgtgactgatgaaaatgttcaaggacttcattttcaactctttctttcctctgttccttatttccacatatctctcaagctttgtctgtatgttatataataaactacaagcaaccccaactatgttacctaccttccttaggaattattgcttgacccaggtttttttttttttttttttggagacggggtcttgccctgttgccaggatggagtgtagtggcgccatctcggctcactgcaatctccaactccctggttcaagcgattctcctgtctcaatctcacgagtagctgggactacaggtatacaccaccacgcccggttaattgaccattccatttctttctttctctcttttttttttttttttttgagacagagtcttgctctgttgcccaggctggagtacagaggtgtgatctcacctctccgcaacgtctgcctcccaggttgaagccatactcctgcctcagcctctctagtagctgggactacaggcgcgcgccaccacacccggctaatttttgtatttttagtagagatggggtttcaccatgttggccaggctggtcttgaactcatgacctcaagtggtccacccgcctcagcctcccaaagtgctggaattacaggcttgagccaccgtgcccagcaaccatttcatttcaactagaagtttctaaaggagagagcagctttcactaactaaataagattggtcagctttctgtaatcgaaagagctaaaatgtttgatcttggtcatttgacagttctgcatacatgtaactagtgtttcttattaggactctgtcttttccctatagtgtgggagatcaagaattgttacaaatcacccctcaaggaaccagggatgaaatcagtttggattctgcaaaaaagggtaatggcaaagtttgccaacttaacaggcactgaaaagagagtgggtagatacagtactgtaattagattattctgaagaccatttgggacctttacaacccacaaaatctcttggcagagttagagtatcattctctgtcaaatgtcgtggtatggtctgatagatttaaatggtactagactaatgtacctataataagaccttctgtaactgattgttgccctttcgtttttttttttgtttgtttgtttgtttttttttgagatggggtctcactctgttgcccaggctggagtgcagtgatgcaatcttggctcactgcaacctccacctccaaggctcaagctatcctcccacttcagcctcctgagtagctgggactacaggcgcatgccaccacacccggttaattttttgtggttttatagagatggggtttcaccatgttaccgaggctggtctcaaactcctggactcaagcagtctgcccacttcagcctcccaaagtgctgcagttacaggcttgagccactgtgcctggcctgccctttacttttaattggtgtatttgtgtttcatcttttacctactggtttttaaatatagggagtggtaagtctgtagatagaacagagtattaagtagacttaatggccagtaatctttagagtacatcagaaccagttttctgatggccaatctgcttttaattcactcttagacgttagagaaataggtgtggtttctgcatagggaaaattctgaaattaaaaatttaatggatcctaagtggaaataatctaggtaaataggaattaaatgaaagagtatgagctacatcttcagtatacttggtagtttatgaggttagtttctctaatatagccagttggttgatttccacctccaaggtgtatgaagtatgtatttttttaatgacaattcagtttttgagtaccttgttatttttgtatattttcagctgcttgtgaattttctgagacggatgtaacaaatactgaacatcatcaacccagtaataatgatttgaacaccactgagaagcgtgcagctgagaggcatccagaaaagtatcagggtagttctgtttcaaacttgcatgtggagccatgtggcacaaatactcatgccagctcattacagcatgagaacagcagtttattactcactaaagacagaatgaatgtagaaaaggctgaattctgtaataaaagcaaacagcctggcttagcaaggagccaacataacagatgggctggaagtaaggaaacatgtaatgataggcggactcccagcacagaaaaaaaggtagatctgaatgctgatcccctgtgtgagagaaaagaatggaataagcagaaactgccatgctcagagaatcctagagatactgaagatgttccttggataacactaaatagcagcattcagaaagttaatgagtggttttccagaagtgatgaactgttaggttctgatgactcacatgatggggagtctgaatcaaatgccaaagtagctgatgtattggacgttctaaatgaggtagatgaatattctggttcttcagagaaaatagacttactggccagtgatcctcatgaggctttaatatgtaaaagtgaaagagttcactccaaatcagtagagagtaatattgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaaaaacagaaccaaataaatgtgtgagtcagtgtgcagcatttgaaaaccccaagggactaattcatggttgttccaaagataatagaaatgacacagaaggctttaagtatccattgggacatgaagttaaccacagtcgggaaacaagcatagaaatggaagaaagtgaacttgatgctcagtatttgcagaatacattcaaggtttcaaagcgccagtcatttgctccgttttcaaatccaggaaatgcagaagaggaatgtgcaacattctctgcccactctgggtccttaaagaaacaaagtccaaaagtcacttttgaatgtgaacaaaaggaagaaaatcaaggaaagaatgagtctaatatcaagcctgtacagacagttaatatcactgcaggctttcctgtggttggtcagaaagataagccagttgataatgccaaatgtagtatcaaaggaggctctaggttttgtctatcatctcagttcagaggcaacgaaactggactcattactccaaataaacatggacttttacaaaacccatatcgtataccaccactttttcccatcaagtcatttgttaaaactaaatgtaagaaaaatctgctagaggaaaactttgaggaacattcaatgtcacctgaaagagaaatgggaaatgagaacattccaagtacagtgagcacaattagccgtaataacattagagaaaatgtttttaaagaagccagctcaagcaatattaatgaagtaggttccagtactaatgaagtgggctccagtattaatgaaataggttccagtgatgaaaacattcaagcagaactaggtagaaacagagggccaaaattgaatgctatgcttagattaggggttttgcaacctgaggtctataaacaaagtcttcctggaagtaattgtaagcatcctgaaataaaaaagcaagaatatgaagaagtagttcagactgttaatacagatttctctccatatctgatttcagataacttagaacagcctatgggaagtagtcatgcatctcaggtttgttctgagacacctgatgacctgttagatgatggtgaaataaaggaagatactagttttgctgaaaatgacattaaggaaagttctgctgtttttagcaaaagcgtccagaaaggagagcttagcaggagtcctagccctttcacccatacacatttggctcagggttaccgaagaggggccaagaaattagagtcctcagaagagaacttatctagtgaggatgaagagcttccctgcttccaacacttgttatttggtaaagtaaacaatataccttctcagtctactaggcatagcaccgttgctaccgagtgtctgtctaagaacacagaggagaatttattatcattgaagaatagcttaaatgactgcagtaaccaggtaatattggcaaaggcatctcaggaacatcaccttagtgaggaaacaaaatgttctgctagcttgttttcttcacagtgcagtgaattggaagacttgactgcaaatacaaacacccaggatcctttcttgattggttcttccaaacaaatgaggcatcagtctgaaagccagggagttggtctgagtgacaaggaattggtttcagatgatgaagaaagaggaacgggcttggaagaaaataatcaagaagagcaaagcatggattcaaacttaggtattggaaccaggtttttgtgtttgccccagtctatttatagaagtgagctaaatgtttatgcttttggggagcacattttacaaatttccaagtatagttaaaggaactgcttcttaaacttgaaacatgttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagctgggattgtaccactgcactccagcctgggtgacaaagtgagactccatctcaaaaacaaacaaacaaaaacacatcatttcccctatagcaaaaacatgacggcacttactgtatcaagagaggtgagaaaaaggagccacagcaggatgattcaagggactctgcatagctccattttaagaatatgcctactgcaggtcagagaaggtaagcaaactgcctaaggccacacagccaggtacagaactctcaccaatattattgccagcaatcgcaattttggtgtttattcttggtaccaagttggagactatagggttctcttcctaatagagaccatctagcctttcactgttttgtggatacttctttctcttcttctttttttttttcccttttaaaatctagttatttttttctttttggtttctttgacacagggtctcttactctgttacccaggctggaatggagtagtgcagtcatggttcactgtagctttgacttcctgggctcaagcgatcctcctacctcagcttcccgagtagctgggaccacaggcgcccaccaacacctccagctaatttttaagtttttactagagacaacatctcactatgttgcccaggctggtctcaaaatcctgggctcaagtgatcccacctcagccttccaaaatgctgggattacaggtgtgtgcaccacgcctggcctattttttttttaattgctcataaatcatcttttttctttaaaaaaaagaaagatgggaggctaaagcaggagaatcacttgaacccaggaggcggaggttgcagtgagctgagatcatgctgctgctctccagcctgggcaacaagagtgaaactccatctcaaaaaaaaaaaaaaagaaagtacacaattttactttctggacctaatggtcaaggccaataatttggtcacctatgaaataaataaaagctttaccatatatatgaccatttgataatgtaatatgaaatgtttatgtactaaaggcagaatagtctagaaaaaacattctgtatcacaacgtctaaaaatgaatatcatcttcatcatagaaccaggctctttctcctaatttttttttttgagatggagttttgctctgtcacccaggctggaatgcagtggcacaattttggctcactgcaaccttcagctcccaggttcaggatcaagtgattttcgtgcttcagccttctaagtagctgggattacaggtgactgccaccacacccagctcatttttttgtatttttttagtagagagagggtttcaccatgttggccaggctcgtctcgaactcctgacctcaaataatccacccgtctcagcctcccaaagtgctgagattacaggcgtgagccaccaggcctggcctcctaatttttatttgtagaagtggcaccaaaattttccaagttctcatgcaaaaattcaggctcatctcagtttatttttttcatttatttatctcccactaaattgacaacttctaataattaggttggttctttgtattcccagcacagggttctatgcagaatacacacacagcagttgctggcaataatattggtgagagttctgtactgggctatgtgatcttagacagtttgcttatgttctctgacctgccgtaggcacattcttaaaatgaagctgttcagaccccctcgattcatcctgctgtggcttctttttcccacctaaatcttaaatacccttttagctgctagtaagtgaatgatgtttttttatgaactttctgaagtcagattagatgaagttgagaaaagcctgatattcttataaagttatatatgtgcatcatagaaaacttagaaaatacagataaacaaaaatcatccatggacgaaccttgaagacattgtgttaactgaaataaaccggacaccaaaggacacatgttatatgcttccacttatatgagatacctagaatagttacatttggttactctgggtacattgcctatagataagccttgctccacaaggagcagttaaaaaaaaaaaaaagataaattcataggatggaaggtagaatagtggttactagggacttggggagggggaaatggggagttactgtttgatgagtgcagatttcagtttgggatgatgaaaaagttctggagatagatagtggcaatggtaacacaacagtgtgaaaataatgccactgaactgtacacttaaaatgattaaaatgataagttaattgtaatttgtgttatccagaaatggttagcaatttattggtgtatattcttttagtattcctgtgtgtgcacaggggtgcttgtatatactttatctttaaaatatatccaggaagctaggcacagtggcttacacctgtaatcccagcactttgggagggtgaggcaggaagattgcctgagccccggaggtcaaggctgcagtgagttgtgatcacgctactgcactctgttctgggcaacccctgtctgggaaaaaaaaaaaaattagtgaggcttagtggtgcacacctgtagtctcagctacttgagtggctggggtaggattgcttgatcccagcaagttgaggccgtggtgagccatgatggtgccactgcactccatcctgggtgatatggtgagaccctgtctcaaaaacaagaaatccagataattctgtgcattataatctagcttttactggatcattaaaattcttttttctttttttttttttttttctgagatggagtttcactcttgttgcccaggctggagtgcagtggtgtgaccttggctcaccgcatcctctgcctcccgggttcatgcgattctcctgcctcagcctcccgagtagctgggattacaggcatgtgccaccatgcccagctaactttgtatttttagtagagacagggtttctccatgttgaccaggctggtctcaaactcctggcctcaagtgatccacccacctcggcctcccaaagtgctggggttacaggcgtgagccaccgcactcagcctgggtcgttaaaattcttaagtgacttcatttttaattactatatgggattctatctttccagtgtatcatgatttatttgacctattgctgaatgttggaggtttcagggtaagaggcacagtttgctattatgtacatcactatagtggcatcctgatagctaaatatttgcctacatccctgattatttccttagtctaaattactgggactaggattttggtgtttgatacatgttactaaattgttttttagaaagattaaaccagtttatgctcttccagcccctgtggtatatgatagttcccattttcctgtaccttgccaacactgggtgatatccagttttaaaatctaaatcttgcattgctatgagaactacaattagagaaggcttatcttctactgcccattctctgtacagagcaaatccctctagacctgaagccccttggagttgtcaagaaacctttgagatgactccccactctgtatctgagctgtcaccagtattctccacttcttcaggattgccatggcaactaaattgatgaaaagatttaggaggccttttctctctttgcaattcctatgatcctttttgaatgtgggtttgggactctgtcaatatacccatcatctaattctgtccattgtgttttaaagtttaaggttgcaatttctgattacatctgccttagccatactgtattatatttgacattcaatatacaatgtccttgtttttctgtatttctaatcttattcccagagatgtgtctatttgttcaggattcattttgcaacgtgtttttactaagcatctacccaaaaccgttgaagtcagatttcaggctgtcttacgtctaaagtagcacaggcaggaaaaactattgaagtgggatttttttttccctttttgtactgaaccgagaaaaagtatatagatgatagagaattcctaatttggtatcattgatatctgggtttttgtttgtttttacagaagactgattaactatacttatttattaatttatcttctcattaataaacacttgctgagtgcttactgtctgctaggcattagggagacaaatatgattaagggaagcttcctcctatcaaggtcatgtgttccatttgggtatactaatgcattagcaatgtaaatcaagtagtgagagatcatctgttcccgataggagatggattattggtggggacttctgtgtgtgtgtgtgtgtgtgtgtgtgtgtgtgtgtgtgtatgtatgtgataaaataaatataggaaatgttaattatagattctaagtagtagatatataaacactcattgcaaagttgcttcaagttttctgtatatttgaaaatattcacaacatgtcgacaaaactagcatgataaagccactatttgtgctaagacttcagcttgtatctggattaggcttattatgtagtagtaggaacattagaaatagttttaactcattaaatacacatgttttatgggaaggttttatatatatatttatatgtaatgaatgtgaacaaacaagggtcagatatacactctgcttccctccagaccagttccggctgctctgctgcacatttcaggagtcttattagaattagccacattctgcccacttgcccttacttctcatatttcacaactcctcctggtggggacttaaggagacattcaaactaggccttgaaagatgagaatttttccaagtggaaaaagaggagtggcagcaagtaaggtaaaggtacagagtcatggaattcccaggaaacgtaaagttgtcatgtgttataggaaaacaacttgtgtgaggggtgttgggagaaatgagagataataccagggtataaagggccttttgaatgctatgttgaggaattttatcctaatggcagtaatgactaacaattatatagtgttcaaaaagtataaatcagcagtggtataccactaagggtttttttcttttctttttttttttgagacagagttttgctctgttgcccaggctggagtgccgtggcacgatctcagctcactgcacttccgccacctgggttcaagtgattcttctgcctcagccagtgtttcactgtgatggccaggatggagcactaagggtctttatggaagaaaaagacatgataaacaaggcttttagggaacttctacagtaatgtagctgtattaaaagtagagatcagagcagcatagtagaagtagaaggctagagctaattgaaggagcacttcagaattagaatcaagaagtcttagaaacctattggttttattctccctaatgtatttggccacttacctgctggggaatttgtctaagttataaaaaataattcctttgggaaacccaaaggaaagttatctattaataattaccccactactttttctgatttatgtaatggccacgtagaggttagatgtgatggttgtgacagtagtgactaatacagcctgtgaagcattttggtcagatatctatgtgctttcattccaggttgactgaggcaagactttggctagggtttgatcagtgatgtaactactcacgagtaccacgtggtggcaatggcattgctgcagaccttggcagcaaagcagtgttagagtagcagtagaaacctttgtgaagctaggaatacattttctggtcataaaaacctcctgaaaattgtgaactcagtgtagcaggagaaagaagatggcttgtttttagtaaagggcaaagtcatttttaaggatcagaagaagaaacggagagtgaaacaatgtgttcctgccctactcccccactggactttttggcaaccattgctgttccttctaaaagtgatttttaaacatgtatattttgaagccaggcacagtgactcacgtctgtaatcccagcactttgggaggccgaggcgggcagatcacctgaggtcaggagttcaagaccagcctggccaacatggtgaaaccccgtctctactaaaaatacaaaaattaggccaggtgtggtggctcacgcctgtaatcccagcactttgggaggccgaggcgggaggatcatgtggtcaggagatccagaccatcctggctaacacggtgaaacaccatttctactaaaaatacaaaaaattagctgggcatggtggcgggcgcctgtaatcccagctactcaggaggctgaagcagaagaatggcttgaacctgggaggcggagcttgcagtgaaccaagattgcgccactgcactccagcctgggcaacaaagtgagactccgtctcaaaaaaaaaaaaaaaaattagtcgggcatggtaacaggtgcctgtaatcccagctacttgagaggctgaggcagggagaattgcttgaaccaggtaggcggaggttgcagtgagccaagatcgcaccactgcactccagcctggggcaacagagcaagactgtctcaaaaaaaataaataaataaaataaattcttaagaaggatattttggaaaactccttacatacctaaattctttgtttatcaaatacttggacttagcacactcttctttgaaatggaccaataaacaacaggagcccataagcaaaaagaactcattattttaaaaacagtaactatccttacaggctttctcagggctctttctgttggatccttccctctcacaggtccttgctaatgatctctaggtggacacattctagatgagatgtccctgtctagaatggcagcaccatgagggctatatcctcagtactaggacagcgcctggtgcttaatagatagtaaatagttgtctaattaactgagcaaacagatagattcatgaattagctttttgctttttctgttagaaactaaaggttcaggtcaggcacaatggcgcatgtctctaatcccagcactttgggaggccgaggcgggctgatcacttgaggtcaggagttcaagaccagcctggccaacatagtaaaaccctgtttctacaaaaattaccaaaattagccgggcgtcttggcaagcacctgtaatgccagctacttgagaggctgaggtgggagaatcgcttgaacctgggaggaagaggttgcagtgagccgagatggtgccaacctgggtgacagagggagacttaaaaaaaaaaagaaagaaagaaagaaaagaaactaaaggttcaaagaatcccagaaaaggaagagtcctcacaagccagtaatctaggcaggattactgatagtatttttatatttgttgtatttttataaaatgccatagatagagggcttttttcaacattacatcagtctaaaaatcacacatttttatatgaactaacctaaatgtctgatgaatctcacaacaccaagtctttgaaatgtgcccatataaataaaatgttaacagattcatgctaattttaaatatcgatagtgtttaaatgccttaattattttttcactccctagctttaaaagaaaataaccaacttcaaaaggacatcacaataacatcaagtctatttgggggaatttgaggattttttccctcactaacatcatttggaaataatttcatgggcattaattgcatgaatgtggttagattaaaaggtgttcagctagaacttgtagttccatactaggtgatttcaattcctgtgctaaaattaatttgtatgatatattttcatttaatggaaagcttctcaaagtatttcattttcttggtgccatttatcgtttttgaagcagagggataccatgcaacataacctgataaagctccagcaggaaatggctgaactagaagctgtgttagaacagcatgggagccagccttctaacagctacccttccatcataagtgactcttctgcccttgaggacctgcgaaatccagaacaaagcacatcagaaaaaggtgtgtattgttggccaaacactgatatcttaagcaaaattctttccttcccctttatctccttctgaagagtaaggacctagctccaacattttatgatccttgctcagcacatgggtaattatggagccttggttcttgtccctgctcacaactaatataccagtcagagggacccaaggcagtcattcatgttgtcatctgagtacctacaacaagtagatgctatggggagcccatggaagatacatggtatacaacatagctcttgctctattggaagctaagtggaatgggagaaattggtgacaggcaaccccataatttcagaaagctatgaaaaagtactcagacatattccttataacactggtgtcacatcacaaagacctatttaatgtgcttctgatttatagggagagacatcctatacttcaggaactgcactttgatccacagaaagcctagtgatgtagagctcctgttagttcaaaaggaaaagaaaagaacaacacagaaagcctaattatgcaatagagtcaagtgctttatagcaatgttacagttatcaaaaaaaatccagatggacctctgagaggatgccattggagtaaccaggcagatgcagttgatcagagctgacttcctataagaagtgagcactgagctgaggaataatggcataaatgaaggaaagtgagatggaaatttgagtttttaattggaaagacaatacatcaggcagatttttaaataggggcaaacaaacagacacataggagatgctaggcatggggtccccactaggatgctgcttagaaacatgcaggggtggtgagtactcccaaagtacacttcattcctagctcagtgattcttatctgagtgttaaagttccttcttcagcaccccgttccacagtccaactgggaactttaagacctttcttggagtctttctaggaactcaagtctgctacttatacagaacagtggctttggtccccagttgtgccttgcagtatttttgtgttcaggaagaaacagtagctcttggataaagaagctagctagaaactctgttgctatggcagtgcttcaaaatgtatttccttaaatgctttctttgtaactatcttcatttagttcatctctcagataatgagagatcagagtcccatccccagtataatactcttctttagggtactttcaccatcttcagtctaaacacagactagactttcaattataatgtgtaagatttaaaatgttattattgtgtgactttgaatatctgtgtaaatctactatctcctctttggtatatacgtgtgtttatttttttctggagatctgtaactgaaatgcttaatttctgaattgttttggatatcacaacttaataccaacataagttttgagcctttttctccctaaatctggtgtgagtctaactgaaactcaaatgaactttttaaaaataattttttcttttctttaattttttttttaagtagagacagggacgcactgttaactaggctggtcttgaactcctgatcttgagccatcctccccgacctgagcctcaccttatagagagggtcttgctctgttgcccaagctggagggcagtggcataatcacagctcactgcagcctctcgacctcctcaagcgatcctcctgccttagcctcccaagtagctgggactataggcgtccaccaccatacccagctaatttttttttttattttttgtagagacaaggtctccctatgttgcccaagttggtctcaaactcctggactcaagcagtcctctcacctcagggtcccaaagtgctggggttacaggtgtgagccatggcacctggccagaacttctagtaaaaagaatattgttgccgggtacggtggctcacgcctgtaaccccagcactttgggaggccaaggcaggcgaatcacctgaggtcgggagctcgagaccagcctgaccaacatggagaaaccacatctctactaaaactacaaaaaattagccgggcgtggtggcacatgcctgtaatcccagctacttgggagctacggtgcctggcctagtttattatttcttaatatctgttgtcttccagtgtcttccttaattcttcacaataccctgtacaatgcttagcacacagtgggcagtctgtaagtttattaaatgtttggtgtggcccatacttcctatccacaaagaatgtaacatgttaagacatctagatgagggaatgatttaagaggaactacaataatattctgaaacttggactctggatctctgcatttagactttcctaaaccagccagcaagtagatcatcatgtcacaaggcttaggttgggcttgctgttcagagaatgaattaaggattaaggagaaaaaaaagcagaaaggttttgctctgtttttcaggttctattgagttgttaacttctaacaagttatcttatttgcttcattgcatgaggcccattgtagtaagaagaggaatttatatgctaaatgttctggtgatagaatgacttttctttttttttacagtccaaaggtcttttttttttttttttaacacctattatgccatgaattcatagggaataggttccagctgctcaggctccttcccattggttctcacaaagtgtgcttctctgggtggagcaggctggtgcttcagttgaacccacgtacctttctctttggcttctttctttttctgatcattttccttcacgcgtttcaggaagctgtcttggctcttagagtgtttaatgtgctcaatacgcacattaattctcttggcaagaatcttgcccttaacttgtttacagcgatgccaacagcatgctgggtcacgttgtagacttttccagttttgccatggtaacacttgtggggcattcctttttgaacagtacccgttcccttgatgtctacaatttcacctttcttacagattcgcatatacatggccaaaggaacaactccatgttttctaaaaggcctagagaacatatatcaggtgcctctcctctttccctttgtgttcgtcattttggcaaattactgaaagatggtggttctggccaaaaggaggaatgactttttaatagctgtgtttgtatctgagccttccctctgcctttcattttttttgttttgttttgttttgtttttgtttgagatgaagtttcacttttgttgcccaggctggagtgcaatggtgtgatttcggctcattacaatgtccgcctcagcctcctgggtagctgggattacaggcacccgccaccacgcccagctaatttttgtatttttagtagagacagggtttcaccatgttggccgggctggtctcaaactcctgacctcaggtgatctgtccacctcggcctctcaaagtgctgggattgtaggcgtgagccacatcacctggccacttttttaactctttccaatggttaattccgtttgatatggttccttggaacttgcacattaccctttatcaattatcaccctgtattgggggtggggaggatgatacctctcttcatagttagatcctacttactttcaacagagttcttaacaatcctagaaactcacaggtccagaaaagacaagcataaaggaaactataaataatgcatttgaagactaactcaggaaatcaatgattatttccccccaggctacccagtgtcttaaaaaaacagtttaattaatacaatcttttgtttcaattttctacctatatttatggcttttagcttttctaataaaagctcaaaatgaattacagtcatcagtgactttttaatgaatagaagacttttgcaatttttaactatttgtttttacttattaaatatttccgccttggccaggcatggtggctcacgcctataatcccagcactgtgagatgccaaggcaggaggatcacttgagtttaagagttctagaccaggctgggtatggtggctcatgcctataatcccagcactttgtgaggccaaggttggcggatcacctgaggtcaggagtttaagaccagcctggccaacatggtaaaaccccatctctacaaaaaatacaaaaattagccaaggggtggtggtgggcacctataatcccatcttcttgggaggctaaggcaggagaatcgcttgaacctggaggcagaggttgcagtgagccgagatcatgccactgtattccagcctgggtaacagagcaagactctgtctcaaaaaaaaaaaaaagtttgaaaccagcctggtcaacacagcaagacacccatctcgttgaaaaataacggtcgggcgcagtggctcacgcctgtaatcccatcactttgggaggccgaggcaggcagatcacctgaggtcgggagttcgagaccagcgtgaccaacatggagaaaccccatctctactaaaaatacaaaattagttgggcgaggtggtgcatacctgtaatcccaactacttgggaggctgaggcaggagaacagcttgaacctgggaggcagagaggttgtggtgagccaagatcatgccattgcactgcagcctgggcaacaagagcaaaactccatctcaaaaaaaataaataaataaaaataaataaataagtacttctgcctttaagccacttcctagaaggcagtggcacaaagtgatacatttggaggagtaaatatattacaaaatgaattaggctgggcgcagtggctcatgtctgtaatccccgcactttgggaggccaaggcgggtggatcacttgaggtcaggagttcgagactagcctgatcaacagggtaaaatcccatctctactaaaaataccaaaaaaactagctgggcgtggtggcaggcacctgtaatgtcagctactaggaaggctgaggcaggagaatcgcttgaacccaggaggtggaggttgcagtgagccaagattgcaccattgcacttcagcttgggcaacagagtgagactccgtctcaaaaaaaaaaaaagaactaacatgccagaactttgccttcagtatgttttgtgatttttcccttcttgtgccatttcatcattagttccatgtattatttaagatttcttatcaaccagcaccttgggatttttttgtgtatgtgttggtttagggggtttatttgtttttttcttttttttcggtaattgaaaatgtgaagcaaaatgtcacctgttttttctttcatgtctgacactcatgtcttgtttacccccgacatgcagaagctgaaatccccatttcatacagtcttcaatgtggaggcagtagggatggagaaaataatgtactttgtgctctccggtactctttctttcctattgtctgaggggatttgggcataatttattttgctgcagagataaaaatttgttatatatattttttatcattcagggccaaggaatatagattttttttttcagccttgtctcagctgggtgtctttatttactctgtcttaaagtgttccttttattatcattattattttttaatcattgaattccatttggtgctagcatctgtctgttgcattgcttgtgtttataaaattctgcctgatatacttgtttaaaaaccaatttgtgtatcatagattgatgcttttgaaaaaaatcagtattctaacctgaattatcactatcagaacaaagcagtaaagtagatttgttttctcattccatttaaagcagtattaacttcacagaaaagtagtgaataccctataagccagaatccagaaggcctttctgctgacaagtttgaggtgtctgcagatagttctaccagtaaaaataaagaaccaggagtggaaaggtaagaaacatcaatgtaaagatgctgtggtatctgacatctttatttatattgaactctgattgttaatttttttcaccatactttctccagttttttgcatacaggcatttatacacttttattgctctaggatacttcttttgtttaatcctatataggttttttgaacctataacataagctacaacatgagaaatgtgcggttagatagatatgtcccttctgaaggtcagaaaaaaatataatggaggtaaaacctgaacaagcttggaaactgatggtagacttcttcaaggcagcccttgccctaattaaaattcttgtctttctagaaaaagtctagctgttgatttaccacagaaaataataataataattactattattattattttttgagacagggtcgccctgtgtcacctagattgcagtggtgcagtcatggctcactgcatcctccgtttttcaggctcaagcaatcctcccaccttagcctcctgagtagctgggtccacaagcatgcgccacccacacccactaagtttttgtatttttggtagagatggagttttaccttgttgcccaggctggtctcaaattcctggactcaagtagtccgcccgccttgccctcccaaagccagaaaacatttagaatatctttcagagatgtgtatttacaccactattaacacagggctgtatagcagtccagtactggactatgtagtccagtactattcttttccttactggagggccaggcgtggtggcaggtgcctgtaatcccagctactcaggaggctgaggcaggagaattgcttgaacctgggaggcagaggttgcagtgagctgggaccgtgccattgcactccagcctgggcgacagagcaagactccgtctcaaaacaaaaaaaaaaagagagagagagcagtaattcaggtctcacccatcttcaatccagggggcctagccttagtatttgacccatagtaagcacccaataattgtttaaattaattaacctctgaggccctttaaatctgttgataagtatcttattttgcaaagtcctaagcacttggaagagcagaggaactatttactgggtgtgtatgcttttctaacaatattttatagctggcttttgtttttagaatgaatttgaacattgaaaaggcaggcaatagggatgattctgtgaattctgctaaaactgagtagaaagaatgagtgtagagatgtcgacattgatcaactttctatcttcataagagatctgattctaacatatccatttagactcaagtagaatattgtgtatagagtgagtggcagtgagtaatttggtaaaaatttgctgacctgcttttattctttcctcctttctttcttcctttccttccttccttccttccgtcctttcctttcctttccctcccttccttccttctttccttctttctttcctttctttcctttcttcctttctttccttcctcccttccttttcttttctttctttcctttccttttctttcctttctttcctttcctttctttcttgacagagtcttgctctgtcactcaggctggagtgcagtggcgtgatctcggctcactgcaacctctgtctcccaggttcaagcaattttcctgcctcagcctcccgagtagctgagattacaggcgccagccaccacacccagctactgacctgcttttaaacagctgggagatatggtgcctcagaccaacccaaccccatgttatatgtcaaccctgacatattggcaggcaacatgaatccagacttctaggctgtcttgcgggctcttttttgccagtcatttctgatctctctgacatgagctgtttcatttatgctttggctgcccagcaagtatgatttgtcctttcacaattggtggcgatggttttctccttccatttatctttctaggtcatccccttctaaatgcccatcattagatgataggtggtacatgcacagttgctctgggagtcttcagaatagaaactacccatctcaagaggagctcattaaggttgttgatgtggaggagcaacagctggaagagtctgggccacacgatttgacggaaacatcttacttgccaaggcaagatctaggtaatatttcatctgctgtattggaacaaacactttgattttactctgaatcctacataaagatattctggttaaccaacttttagatgtactagtctatcatggacacttttgttatacttaattaagcccactttagaaaaatagctcaagtgttaatcaaggtttacttgaaaattattgaaactgttaatccatctatattttaattaatggtttaactaatgattttgaggatgagggagtcttggtgtactctaaatgtattatttcaggccaggcatagtggctcacgcctgtaatcccagtactccaggaggccgaggcaggtggatcagctgaggtcaggagttcaagacctgtctggccaacatggtgaaaccctgtctctactaaaaatacaaaaaaattaactgggtgtgctagtgcatgcccgtaatcctagctactctggaggctgaggcagcagaatcacttgaacccgggaggcggaggttgcggtgagccaagatcacaccactgcactccagtctgggtgacagagcaagactccatctcaaaaaatatatatatatatatatacacacatatattttatttcaactgttagacaagagtccaaaggccaaagaataaagttttaggccagtcctttattagaaaatgagtcaaatcccaaagcaagtttttttatgagttaatgaatataaatgactacatattttatgccttaaaaatcacttttaatgaatggtgttttatggcttgtaaatcagagttttaatcagtaaagaaagtttttaatcctcaaaaacacgttatcataaaagacactgtttggcatcaaatgtggtatttggccatgttcattagggtcattttaggaatctcatacattctacttagctatgcttaattcctgataccatggcattttctgaaatgtttcaaggatgacatctctgctgtttttaatttggtaatgatatctgctgatttattaagtgaaaaaagtaatggtgtcattaccttggatgaagaaacaaaaataaagcatttgccacatttttcaactttgttttcctttcttacaaaattgctataagctcattgcccccaaattggacaatatagggaataaaaaagataatttggggtggggttagacacgggtcttgttatgttgccgaggctggtctctaactcctggcctcatgcaatcttcctaccttggcctcccaaagtgctgggattataggtgtgagccacttcaccaagctgagatgccacctcttaaaagagagaataaggacagattacagccactgctcatgcctgtaatgtcagtactttgggaggccaaggtgggagaattgctcgaggccaagagttcaagaccagcctgggcaatgtagcgagacctgatctctatgaaaaggggggtgggggggaaaactagctggggccaggcgtggtgggtggcttacgcctgtaatcccagcactttgggaggccgaggcgggcagatcacctgagggcaggagttcaggaccaacctgaccaatatggagaaaccctgtctctactaaaaatacaaaattagccaggcttggtggcttatgcctgtagtcccagctactcgggaggctgaggcaggagaatcgcttgaacctgggaggcagaggtttcagtgagctgagatcgcgccattgcactctagcctgggcaacaagaatgaaactccatctcaaaaaaaaaaaaaatcagctggaaggtggcaaacacctgtggtcccagctactcaggaggctgagacaggaagatcacttgagtccaggaggtcaaggctgcaggtgagccatgtttgtgccactgcactgcagcctggatgacagaccgagacccttctcaaaaaaaaaatttttcccggtatttttttttgggggggggtttaattcttgttgcccaggctggggtgaattggggaattttgggttaagggaaccttcggcttcctgggttggggggtttttcctgtttaggcttccccagtagctgggattacaggcatgcaccaccacgcccggctaattttttgtatttttagtagagacagggtttctccatgttggtcagactggtctcgacctcttgacctcaggtgatccgcccaccttggcctcccaaagtgttgggattacaggcctgagccaccgcacccggcctgtactcttattctttaataataaaatatttctgtgtttctttagtcattttacataaacttttatttatttatttatttttatttatttatttttttgagacggagtctcgttctgttgcccaggctggaatgcaatggctcaatctcagctcactgcaagctctgcctcccgggtacacgccattcccctgcctcagcctccctagtagccgggactacaggcgcccgccaccacgcccagctaatttttttttttgtattttcagtagagacagggtttcactgtgttagccaggatggtcttgatctcctgacctcgtgatccacccgtctcggcctcccaaagtgctgggattacaggtgtgagccaccgtgctcggcccataaacttttatttttaaaataatgtcatgataaataatattgcttaggtgtctttaatatattagtaacatttctgttttattgtacatcaacatttatattcaaattaatgggtgaagagtactccattggactaggtatatcgtaatttaatctcctattattggacaactacattgtttctaaaattatactattcctatgactaaacctttgcatatatcttttatctccctaggatatatttctaaaactagcattgttgactgaaagtgtaaatacgtgttaaggtgtttgctacataatgccatatttcctttttaggaaactaagctactttggatttccaccaacactgtattcatgtacccatttttctcttaacctaactttattggtctttttaattcttaacagagaccagaactttgtaattcaacattcatcgttgtgtaaattaaacttctcccattcctttcagagggaaccccttacctggaatctggaatcagcctcttctctgatgaccctgaatctgatccttctgaagacagagccccagagtcagctcgtgttggcaacataccatcttcaacctctgcattgaaagttccccaattgaaagttgcagaatctgcccagagtccagctgctgctcatactactgatactgctgggtataatgcaatggaagaaagtgtgagcagggagaagccagaattgacagcttcaacagaaagggtcaacaaaagaatgtccatggtggtgtctggcctgaccccagaagaatttgtgagtgtatccatatgtatctccctaatgactaagacttaacaacattctggaaagagttttatgtaggtattgtcaattaataacctagaggaagaaatctagaaaacaatcacagttctgtgtaatttaatttcgattactaatttctgaaaatttagatctagataaagctatagtgtggattattttatgtatatttacttgagaaaataattattaaatattagtggaaaagctatactttgggtatgatataggactttcgaattggaattttcctttctatctgtaaaagcaagtaggtatagttttattccccagaaggcatctttttctcccccttgtctcacatgggtgaatttaccagcatatttaactaaattcagactggttccaaatgtactgccagatagtagcatttctctagtgtttgttttcatcctggcttgtaagaatgccctgccacttctgccctgcaatatcccttgctattaggattttggcatcaccttgggtccttaatgccagaaatgggaattgcttcatactgtggaaaaatacccattaaaatattaagaccagtaaaacctcgtttctgcttgggctatttgtggatttcagacatcctgagaagtttaccacccctgtaattaattgtcattgtcatcacttcataataaaaataattgcatggccgggcatggtggctcaagcctgtaatcccagcactttgggaggctgaggtggtcagatcacctaaggtcaggagatcaagaccagcctgaccaacatgaagaaaccccatctttactaaaaatacacaattagccgggcgtggtggcgcatgcctataatcccagctactcaggaggctgaggcaggagaattgcttgaacccgggaggcggaggttgcggtgagccgagattgcaccattgcactccagcctgggcaacaagagcgaaactctgtctcaataataagaagaagaattgcgtgaatatttctttaaaactatgatgagataacataccagattatcaaatggattcagtagtgggtgtgccatttattgcacactgagagatgaccaagtcattctgaaatatctttattaatatatccttcctaggatttttcatcctaacttctccataggtagttacttagcataacatctctgtggccagatgtatcccactactaaaagggcaaagtaagctgtggctgccctggtagatacaatgagtaagtgcacagtgatggctataaatgttttcatctcataatcccatgtccagaccagcaatttgctctgaaagctcttacctgtgtctgtttcaatggctcttgatcacttgcctgcacgtccagaattccttatttattcattgaaaattagcgttctttatccctttgttttgcaagttcagctttttagagatggctaaaatggtctaatctttcttggcaaaggcaattctgagctgcagattagactacaagtggcttgggtacatgttgtctttaaacaagcgaagaggaaaactttgagctctattcagacttggtgaagtgtggtaaatttatgatgaaagctactgactgtattacacatgattaattctgaagcccatattaagatgatcttttcagcagttcagcattgctcttctaactgaacagtttcaaggctgggatttcagcaattaatcagttcagaattgctaatgatctggcggagggtggtagcaaaagggggaggatgtcattagcttctctagcctgccttttttcagtgccctgtggcagtatggagtgaggcaacatgaaagaaagatggcctgaccttcatggcagtattgtgcaacacgtaaatactggtgtgagtggctgtggctatggctagtaaatgatggcccttggtaaacaaagttatttatcagacaatacctaccagctaggtcaactgtgcccataattgatctggttaatttcttttgctgcctattgatttttatttggttgatagataatagctagaggactctaaatttctttggggaagaacatgaaccccttctaagccttcttacgagagaattgatcgcttttgcactgacctttagtaacatcctgatttcagtgttttgtaactatcagagggttgagtcttggttttaagccatgtatatctgtagcataactttctgtgtaggctagttacctctcagcttataaagtgtaggctgataaatttatagtacagtagagtgtcactatgcaaagaaacgatcttagggaatcgaatgatatctgctattaaagcaaaattaatatatattttttctttttacttttttttttttttaaagacatgaaatctcactgtattgcccaggctggtcttggtctcagactcttgagctcaagcagtcctcccacctcagcttcccaaagtgctgggattataggcatgagctgccgtgtctggcccagtatatattttttaagttttaagttttgtggtacgtagtaggtttataatattattttgaatccttagttgtaattttatgtctgctgatgtgtacataatttttattaaactatttatttgagacttcaggtatcttttttttttttttgagacggagtctcgcactctcgcccaggctagagtgcagtggcgccatctcggcttactgcaagctctgcttcctgggttcacgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtaccctttctgagaaaaacagagacttaaagctaggataactggtattctattttttttttttttttttttttttacctccagcctgggtgacagagcaagactctgtctaaaaaaaaaaaaaaaaaaattcactttaaatagttccaggacacgtgtagaacgtgcaggattgctacataggtaaacatatgccatggtggaataactagtattctgagctgtgtgctagaggtaactcatgataatggaatatttgatttaatttcagatgctcgtgtacaagtttgccagaaaacaccacatcactttaactaatctaattactgaagagactactcatgttgttatgaaaacaggtataccaagaacctttacagaataccttgcatctgctgcataaaaccacatgaggcgaggcacggtggcgcatgcctgtaatcgcagcactttgggaggccgaggcgggcagatcacgagattaggagatcgagaccatcctggccagcatggtgaaaccccgtctctactaaaaaataaaaaaattagctgggtgtggtcgcgtgcgcctgtagtcccagctactcgtgaggctgaggcaggagaatcacttgaaccggggagatggaggttgcagtgagccgagatcatgccactgcattccagcctggcgacagagcaaggctccgtctcaaaaaaaaaaaaaaaaaacgtgaaaaaataagaatatttgttgagcatagcatggatgatagtcttctaatagtcaatcaattactttatgaaagacaaataatagttttgctgcttccttacctccttttgttttgggttaagatttggagtgtgggccaggcacggtggctcacacctgtaatctcagcactttgggaggccgaggcgggtggatcacctgaggtcaggagttcgagaccagcctggccaacgtgttgaaaccccgtctctactaaaaatataaaaattaggtgggcgtggtggcaggcacctgtaatcccagctactcaggaggctgaggcagcagaatcgcttgaacccaggaggtggaggttgcagtgacccaagatcgcaccattgcactccagcctggggacaagagcgagattcttgtctcaaaaaaaaaaaaaaaaaaaaaaggtttggagggtggtgagctgagatagtcaactattaactcctatctacctgctgggactacactggtgaggtggagcctaagtcctaaaacaacaagtgaggcagctggacgcggtggctcgcatcagtaatcccagcactttgggagcctgaggcgggcagatcacaaggtcaggagttcgagaccagcctggccaatatggtaaaacccagtctctactaaaaatacataaattggctgggcgtggtggtgtgcacctgtaatcccagctacttgggaggctgacacagaagaattgcttgaactctggaggctgaggttgcagtcagctgagatcctgccactgcactccagcctggcgacagagtgagactctgtctcaacaacaacaaaagaaagaacaagtgaggcaaaacctggagaccccagcttcatgtaacacctagtttgagtattgttgagagtttttcaggaaaaaagtctgataacagctccgagatagtcttaacatatgaaaaagcaaaaaagggaggagacagatcatttgtcctatacctttctcttttaaggttttaattataacttgtgtaatacaggagacctctgggtgtttttagttgactataaactaaatctgagtacacatttcagggctgctaaaaatgcttatttgaaactgggccgtattaacacaagcagaggctctggagcaagtgaagtacagatccagagccccactgtattctccaatggagtgattgcctgaaagatgatgtcagttttaagcaccgtgcttggtttttaacatggtcactgacaaattggagagtgtttatccagaggtagatggtaaagatacataaaagtaacttgaaatactgtcttttgaagaagaaatgagaagatttaaggaaataagacactgtcttcaagtatctgaagaaccgttacccggaagagaactgttatctggaacaggattaagactcactcatggggctccagaaagcagacgagtgcatggaggacgcagaagatgcagattgtgtggctcaactctaaaatctttctaacaaaattagttctctggatgtgttccagttcacttgatgatgattcttttgtttttgtttttgtttttgaggtgtagtttttcactcttgttgcccaggctgctggagtgcaatggcacgatcttggcttgctgcaacctccccctcccgggttcaagcgattctcctgcctcagcctcccgagtagctgggattacaggaatgcaccaccatacctaattttgtatttttagtagagacagggtttttccatgtcagtcaggctggtcttggactcccgacctcaggtgatccacctacctcggcctcccaaagtgctgggattacaggtgtgagccatcgcgcctagcctatgatgattcttttcacagagatacaggcacttaaggagaggatctaaaccccttggacacattgccgttgaacttctaagatcttaggtttccacttactcatgaaaattataccacagggtcagagggtagtgttcattggagccaggtgccagaacaagttattacaaactactattttagagaaaaatgtcattaaagtttaagataccttaagctataggtttgcatcaaagttaatgaaaggtaaaaagatgccaagcgtggtggctcaggcctgtaatcccagcgctttggggggccaaggcgggcagatcacgaggtcaggagatcgagaccatcctggctaacacggtgaaaccccatctctagtaaaaatacaaaaaattagccgggcatggtggcgggcatctgtagtcccagctactcaggaggctgaggcaggagaatggcatgaacccaggaggcagagcttgccgtgagctgagatccagccactgcactccagcctggctgacagagcaagactgcatctcaaaaaaaaaaaaaaaaaaaaatgcaaatcaaatctaaagtagttcagtctttaaactcaaagccaatacatttgctttgaactacaaatgaactgaagtttttaagtgtaataaatgttactaaatcggcttttgtagcagttaaacaaaaaacttcaaaaattgtaaggattctgtgagggagcatggctgctgctgctgctgctgcttgcagatagcctgctgtgtttaggatttagttaaatacatttctcctgtttaaaactaaatggtctttccttagtttgcttagttcttcagaagggcctttgaaacactgggaaataaacaagtgattctttagctactgctttctgaaatacttatataaaagctctgcactgtattctcccatccctctcaggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggacagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtgaaaagagcacgttcttctgctgtatgtaacctgtcttttctatgatctctttaggggtgacccagtctattaaagaaagaaaaatgctgaatgaggtaagtacttgatgttacaaactaaccagagatattcattcagtcatatagttaaaaatgtatttgcttccttccatcaatgcaccactttccttaacaatgcacaaattttccatgataatgaggatcatcaagaattatgcaggcctgcactgtggctcatacctataatcccagcgctttgggaggctgaggcgcttggatcacctgatgtcgggagttcaagaccagcctgaccaacatggagaaaccccgtttctactaaaaatacaaaattagccgggcttggtggcacttgcctgtaattccagctactcgggaggctgaggcaggagaatcacttgaacctgggaggcgggggttgcagtgagctgagatcgcatcattgcactctaacctgggcaacaagagcaaaactccatcaaaagaaaaaaaaaatcgggtgcagtggctcatgcctgtaatcctaacactgtgggaggccaagacaggcagattgcctgagctcaggagttcgagatcagcctgggcaacatggtgaaaccctgtctctactaaaatacaaaaaattactcagcgtggtggcatgcgcctttagttccagctactcaggaggctgaggcaggagaatctcttgaacccgggaggtggaggttgcaatgagccaagatcgtgccactgcactccaacctggcaacagagcgagactccgtcttaaaaaaaaaaaaaattttgcagcgcaaaccaggatatcctctgttctcatttgttctagatttcaaaagaaacagtcctttctttggggaaaagagaaaggaaaaggagttttataaaaggaaagaaaagattcataagaacaagaagtgggcccacttgcatatacctttgtagaaaactgttcactgttgttgaagaaaagctcttcatattaatatgcagtccagatgcagtggctcacacttataatctcagccctttgggaggctgagacaggaagattacttgaggccaggagtttgaaaccagcctgggcaacatagtgagactctgtctccacaaaatttttttttaattagccgggcatggcagtgtgcttctgtagtcttagctactgaggaagctaagccagaagaatcacttgagcccaggagttcaaggctgcagtgagctatgatcataccattgcactcttgcacttgcacagagcaagaccctgtctcttaaaaaaaaaaaagtgtgtgtgtgcatatgcatatatacatatatatacatgcaaatgtatctgtttataattcagattgcttcaaaaagatgttgcactttatgatactgagaacagtgagaagtaaataagatagagtgtaggaggaggaataatttcagaacagccatctgagaacttctgtgacaacagatcaggcaaaatgaaatgtgaaagtaattttataggccaggcgtggtggctcatgcctataatcccagcactttgagtggccaaggcaggtggatcacttgaggtcaggagttcgagaccagcctggtcaacatggtgaaaccttgtctctactaaaaacacaaaaaaattagtcgagcgtggtggcatgtgcctgtaatcctagctgctggggaggctgaggcaggagaatcacttgaacccgggaggcggaggttgcagtgagcctagattgcaccactgcactccagcctgtgagacagaatgagaccctgtcttaaaaaaaaaaaaaaagtaattttataaactattgtgcacaattcgatgtattcataattaattaaatgattatttttgttggttttaacttttattcagtggctatttattgggagcctactgtgttctgggcactaggaatgcaacagtaaataagactaactaagtccctggtaggattcaggttctgtcgaggggagatacacaataaagatgaatttaagataacaataaatgctatggagaaatatacagaacagtggaatagtattagctgtcaaaggttgttgattactttcgtttaaggaggccagggaaagcctttctgaaaaaattgagctgagacctaaataacaagaaataattgtccttgaaaaatgaagggaatgcatcttataggcagaggaatagcaaacataaaggtcttgaggtaataatgagtgtggttttttgatttctgtattttggtttttttgagatggtgtctccctctatcccccaggctggagtgcagtggcacaatcttggctcactgcaaactctgtctcctgggttcaagcaattctcctgccttggcctcctgagtagctggtattacaggcacgcgtgctaccacacccgactagtttttatttttagtagagatggggttttaccacgttggtcaggctggtctcaaactcctgaactcaagtgatccaaccacctcaacctcccaaagtgctgggatcacaggcgtgagccaccatgcccggccagagcttggtttattttttaaaagataggccaatgttggtcgtgtgtggtggctcgtgcctataatcccagcactttgggaagccaaggcaggcaaatcacttgaggtcaggagttcgagaccagcctggccaacatggtgaaaccccatctctactaaaaatacaaaaaactagcatggtgtggtggtgtgtgcctgtaatcccagtgcctgtaatcccagctactccagaggctgaggcaggagaatcacttgaaccgaaaggtaggagttacagtgagccaagatcgcatcactgcactccagcctgaacgacagagcaagactcctgtctcaagaaataataatgataaaaggttcgggcacagtggctcacacctgtaattccagcactctaggaggccgaggcaggcagatcccctgaggtcaggagtttgagaccagcctggccaacgtggcaaaaccccatctctactaaaaaatgcaaaaattagctgggcacggctgggtgtggtggctcattcctgtaatcccagcactttgggaggtcaaggcggacagatcactgaggtagaaaccctgtctctactaaaaatacaaaaatttgcccagcgtggtggcgcgtgcctctaatcccagctacacgggaggctgagacaagagaatcacttcatcaacccgggaggtggaggttgtggtgagctgagatcgcaccattgcactccagcctgggcaacaagagtgaaactccatctcaaaaacaaaaaaaaattagctgggaatggtggcatgtgcctgtaatcacagctacttgggaggctggggcaggagaatcgcttgaacccaggaggcggagattgcagtgagctgagattgcgccactgcactccaggctgggcgaaagagcaagactccgtctcaaaaataataataataataataataggccagtgtagctggagtaatttgcaaattatgtgtggaggcagagattacacaaggaatgggagaaggtcatagatgagggccagatcacatagtatttggtggtaaggaattcagattttatccttgtggtaattggtggtgtggagatggttaaaaacaaggttggtttgggatgggtttgaagagaggacttgctaatggattaaatttggaggataaggtaaagagaaattgaaggagtgacacttgggttttggcttgaacaatagatcttgttagtaatattaaattagatgaagaaggcatggtagggaatatgggggagtgggaaaggcaggaagcaggaatggaaccaggaactctgttttagatgtgagaatttgttgttgttgttgttgttgttgttgttgttgttgttgttgttgtgacagcatctcgttctgttgcccaggctagagtgcatggagtgcggtagcacgatctcagctcactccaacctccgcctcccggttcaagtgattttcctgcctcagcctcccgagtagctgggattacaggcacctgccacaatgcctggctaatacttgtatttttagtagagatggggttttaccatgttggccaggctggtcttaaactcctgacctcaggtaatccacccacctcggcctcccaaagtgctgggattgcaggtgtgagccactgtgcccggccagatgcatgaattttgagatgtatactagacttctggatagagaagttaagtaggcagttggacacattgtatgaagctcaggggtacaaggaggactatgaacatgggagtcttctgacaaatttatcactagactcctcattcaagtaactaggaaatgtcagatattcttcccctagtaatagccagtggttatactcttgcctttagttttcttcacaatactcttggcaacacataaggccttccctacaatctgagtttcagtcagaattgtttctgagcgttcttcctcaaatttctccccagtctcattattctttattctcatgtccatgaccagtcataatagtaattatgaaaaacctctaactttctttagtgcattgaatgtatattttatcattttggttgtgttaactgtaaatctctcagtggaaatctgaaaagcctttatttccttagatgataatatacaattgatttaggagatagggaatttttcagttacctttataacagcacagtattagcagtctaatctaaatgctaagtgaatgttttgagaggagatagatgttgaaaattaaaatacattaagtcccagtgaggtgaaaagccgattgttaagttctgcacacaaaagatttgcttcagtgaattgatttcaacagctgagatcctagtcatttcacctggtctaccaaaaagaatgattttacttgcttttggtcaaatctctgcccagcaattctttttctttctttcttttttttgttttatgtgtgtgtgtgtgtgtgtttttttttagcagagtctcactttgtcacccaggcgggagtgtggtggtatgatcacagttcactgcagcctccaactcctgggctcaagtgatcctccagcttcagcttttcaagaaattgggactgcaggcacatgcaactatgcctggctgaggttttatgtatcttttttctagagaaggggtctcactgtgttgcccagctgggtctccagctcctggtctcaagctgtcctcctgcctcagcctcccaaagtgccaaagtgctagggttataggtgtgagccattggtgcccagctactgcctgcctggcaattctgaatgccttaaattttttttttttttttttttttttttgagacagagtttcactctgtcacccaggctggagtgcagtggcatgatcgtggctcacagcaacctctgcctcctggattccagcaattctcatgcctcagcttcccgagtagctgggactacaggtgcatgccaccacgcccagctaatttttggtttttttgtttgtttgtttgtttgttttgagacggagtctcgctcagttgcccaggctggagtgcagtggcgtgatctccgctcactgcaagctccgcctcccgggttcacgccattctcctgcctcagcctcccgagtagctgggactacaggcgcctgccactacacccggctaatttttttgtattttaagtagagacggggtttcaccgtgttagccaggatggtctcgatctcctgacctcgtgatccgcctgtctcggcctcccaaagtcctgggattacaggcgtgagccaccacacccggcctaatttttttttttttaattttatttttaattttttgagatgcgagatggagtctcgctctgttacccaggctggagtgcagtggcaccatctcagctcactgcaacctccacctcctgcattcaaaagattctcctgcctcagcctcccaagtagctgggattacaggtgcctgccaccacgcccaactaattttttgtatttttagtagagatgaggtttcaccatgttggtcagactggtgtcgaactcctgacctcaagtgatctgcctgcctcagtctcccaaagtgctaggattacaggggtgagccactgcgcctggcctgaatgccttaaatatgacgtgtctgctccacttccattgaaggaagcttctctttctcttatcctgatgggttgtgtttggtttctttcagcatgattttgaagtcagaggagatgtggtcaatggaagaaaccaccaaggtccaaagcgagcaagagaatcccaggacagaaaggtaaagctccctccctcaagttgacaaaaatctcaccccaccactctgtattccactcccctttgcagagatgggccgcttcattttgtaagacttattacatacatacacagtgctagatactttcacacaggttcttttttcactcttccatcccaaccacataaataagtattgtctctactttatgaatgataaaactaagagatttagagaggctgtgtaatttggattcccgtctcgggttcagatcttagctgataagtggaagagctgggactttaagcagatgagaatctaaagactttgctcttttcacttcactggggtgtctttctctctctctctcttgctctctctctctctttttttttttcccaagacggagtctcactccattgcccaggccagagtgcagtggtgcgatctcagctcactgaaaactcatcttgcccaggctggtcttgaacccctgaccttgtgatcctcccgccttggcctccccaagtgctgggataggcgtgagccaccgtgcccagccaataatagctaaaatttatataatgttcactgggccaggcacagcggctcgttcctgttatcccagcactttgggaagctgaggcaggcagatcgcttgagccaaggagttcgataccagcctgggcaacatggcaaaaccccatctctaccaaaaaaaatatacaaaaattagccaggcgtggtggcatgtacttgtagttccagctactcggaaggctgagttgagagtatctcttgagcccaagaagaggggactacagtgaacggagattgcgccactgcactccagcctagacgacagacagaagatctcaaaagaaaaaaaaaaaaaaaagatcactttatgctgggactgctctaaaggcccaaccatgttttaactaattaacaattttatgacaactctatgagctatgtactgtaattatgcctatattacagatgtgaaaattgaggctcagagaggttgaataagttgctcaaagtcacacaggtaataagtgatggaactagaagttgaactcaggaagtctagctccaagtctaaattctttgttaatttatttttcgggccagagtcttactctgtcacccaggctggagtgcagtgccactatctctgctcactgcaaccttcacctcccaagttcaaaccttgttcaattcttgtgccttggcctcccaagtggctaggattacaggcatgtgccacaacaactagctaattttttgtctgattctgttggccagtctggagtgcagtggcgcaatctcagctcactgcagtctccagctcccaggttcaagtgattctcgtgccttagcctcccaaatagctgggattacaggcacgtgccaccacaccgagatagttttttgtatttttaatagaaacaaggtttcaacatgttggccaggctggtctcaaattccagacctcagatcatctgcccgcctcaggctcccaaagtgctgggattacaggcatgagccactgcacccggccttaatttttatatttttattagagatggggttttgccatgttggccaggctggccttgatctcctggcctccagtgatccacccgccttggcttcccaaagtgctgggattacaagcatgagccactgcacccggcctccaattctaaactcttaacaacaatactatagtttcttgaaaagttgttgaaggcttcacggagggaaaaaaaatggagcattctaacaactttgcagatgagacccaagaagactcaatgactttctcctgatcatattgtagcagatgacttagccagaactctgacttcctcacagggagaaagtctgcaagatttcacacttacctgtcaggcctgagctggctgctttctcagctccctaagtgctatgttcccagtctgcttttcttcctttttcaagtgtgcactaccaggcatttcagaacatcccaggctggtcgcggtggctcacacctgtgatcccagcactttgggagcccaaggcgggtggatcacctgaggtcaggagttcgagaccagcctggccaacatggtgaaaccccatctctactaaaaatacaaaagttaactgggcgtggtggtaggcacctgtaatcctagctcaggattactcgggaggctgaggctagagaatcggttgaacccaggaggcggaggttgcagtgagccaagattgcgccactgcactctagcctggggacaagagggagacttcatctcaaaaaaaaaaaaaaaatcccagctgggcacagcggctcacttctgtaatcccagcactttaggaggccaaggcaggaggatcacttgagcccaggagttcaagactagcctgggcaacatagtaagaccctgtctctacaaaaaaatttaaaaattaattgggtgtcgtagcacactcttgtattcccagctactcaggaggctgaggtgagaagaatgcttgagtctgggaggtcgaggctgcagtgagccatgatggtgctactgcactccagcctggccaacattgtgagaccttgtctcaaaacaaaacaaaacatccttctactgagcactttctgtccctttatagaaacttaagagggaaccagtagaggtaatttcctaaggaaaactgctttgggacatgatcacaaatgaagcctggagttttgaactgctgaggtcagcctgtttttaccttctgagcctatcaagtaattgttccagatgccaagaaaagctgctggccttatttctgcttctgcctttaccacaggggagcgccatgtgagccagtcctctgtttttcctccactgtatgctaggcagtattagcaccagattcttcccctctttaaaaagaaattctagtgctttggattttttcctccatgcagaatagcaatgatggaaagtatgtggtcaaagtaatgacattctgaaaatactaaatgtcaccatagtatttttctctggaagagaaatgtatatgtagaggtgaaacttcaaatttctttttttttttttttaagacgaagctttgctcttcttgcccaggctgaagtacaatggcgtgatcttggctcaccgcaatctctgcctccagggttcaagtgattctcctgcctcagcctcctaagtagctaggattacaggcatgtgccaccacgcccagctgattttgtatttttagtagagatggggtttctccatgttggtcacgctggtcttgaactcccgaccccaagtgatccacccacctcggcctcccaaagtgctaggattacaggccaccgcgcccggcctgaaacttcaaatttctttttttttttgagacagagtctcgctatgtcacccaggctggagtgcagtggcgccgtctcggctcactaccagctccactccacctcctgggttcacaccattctcctgcctcagcctcccaagtagctgggactacaggtgcccgccaccatgcccagctaattttttgtatttttagtagagacgggttttcactgtgttagacgggatggtctccatctcttgacctcgtgatccgcctgcctcagcctcccaaagtgctgggattacaggcgtgagccactacgccaagcccgaaacttcaaatttcttatctcataactaggcatccttatcactgagtgttagcctggatataaacattcctaatcttttgtacttttcatgtcagcatttggctccacttggctgcctggggagaacttctagcattatgagcatgcaggtcctatcaacaggttgggggtgcggtttattcatacaggtagtgagagtggcacagatggatgctgtcccttaaaacaaacagacttgtctttgggagcctgaggcgggtggatcatgaggtcaggagttcaagaccagcctggccaacatagtgaaaccccgtttctactaaaaatacaaaaaattagccgggtgtggtggtgtgcacctgtaatcccagctactagggaggctgaggcaggagaatcacttgaacccaggaggtggaggttgcagtgagccgagatggcaccattgcactccagcccaggcgacagtgcaagactgcgtctcaaaaaaaaaaaaaaaacacacagacttgtcctactgccatttcttttcactctggcggtaaagtaagagtgtgtgtgtgtgtgtgtgtgtgtgtgtgtgtgtgtgtgtgtgtgtgtgtttctgtccgtctgtctgtcaagggggagggtgaccactttctaaaaggccatccgtgtatttttagcttcctgatttttttctctatcgcagtctctttgaagccaggtgaattttaggccttggcaattttctttttattgcaatgggaaggtcaagacactgagagtcacccaaaacatatccatccaaaatgatacaattttagggtttatttttaagtgatacccaagttatttgctaagaacctatgccagtgtgtttatgagaatttgcactgtcccacactgttgccaccagccacatgggactgtttaaatttaaattttacaaattagccagtcatggtggtgtgcacttgtagtcccagctacttaggaggctgaggcaagaggattgcttgagcccagaagttcaatactgcagcaagctatgatcgtgccactgtactccagcctgagtgacagaatgagacctcatctcttcaaaaaaaaagaaaaaaattaaaatatgaagtttagttcttcattcaccctaaccacatctccagtgctcaataactatatgtgactcatggctaccttattagcatagatatagaacattgtgactatcacagaaagttgttttgaacagtgttgccaagccctgtaagtggaagaggcagtgcagtgtgatctgtgtcttcaggaaaccaggtagtcagactagttcaatgaggagaggcagaacctggcttcacttctagattaaaaactgcttaggtggcctaaagatacaatggccattctcagagtagtgagaaggaaggaacagatgtttagggggctagaagaaagtcagagagggccgggcgcagtggcttatgcctgtaatcccagcactttggaaggccaagacaggcagatcacgaggtcaggagttcgagaccagcctgaccaacatggtgaaaccctgtctctactaaaaatacaaaaattagccgggcgtggtggtgcgcgcctgtaatcccagctactcaggaggctaaggcaggagaatcgcttgaaccctggaggcagaggttgcagtgagcccagatcgcaccactacgctccagcctaggtgacagagagagactccgtctcaaaaaaaaaaaaaaaagtcagaggagacaaggagcatgtacacctaaaatcaacatagacccctctgttgatggggtcatagtgagtacttgaggtaccaagtctggataaacatcaaacttcagccaataactttgagtttctagccatccaagcctcttattaaacatacagaaggaccttttttcccttgcatctaacaagttaaagcacctgcagagatcattagggaggagccttggcctgattggtgacaaaagtgagatgctcagtccttgaatgacaaagaatgcctgtagagtgcaggtcaactacatatgcacttcaagaagatcttctgaaatccagtagtgttctggacattggactgcttgtccctgggaagtagcagcagaaatcatcaggtggtgaacagaagaaaaagaaaagctcttcctttttgaaagtctgttttttgaataaaagccaatattcttttataactagattttccttctctccattcccctgtccctctctcttcctctcttcttccagatcttcagggggctagaaatctgttgctatgggcccttcaccaacatgcccacaggtaagagcctgggagaaccccagagttccagcaccagcctttgtcttacatagtggagtattataagcaagatcccacgatgggggttcctcagattgctgaaatgttctagaggctattctatttctctaccactctccaaacaaaacagcacctaaatgttatcctatggcaaaaaaaaactataccttgtcccccttctcaagagcatgaaggtggttaatagttaggattcagtatgttatgtgttcagatggcgttgagctgctgttagtgccaacatgttagtgagaaaatatctttggataggtaaaaatcaaggaggagttctcctcttcctaaaccatcttaatttacttacatagaagaaagcacagcagctggcccaccacggacgggcccagagcaggggaagattctcggtgaacatttctttttttttttctttttttttgaggtcgagtctctgttgcccaggccagagtgcaatggcgcgatctcggctcactgcaacctccacctcccgggttcaagtgattctcctgcctcagcctcccaaatagctgagactacaggcgtgtgccaccacgcccgactaattttttgtattttttttttagtagagacggggtttcaccgtgttagccaatatggtcccgatctcctgacctcgtgatccacccgcctcagcctcccaaagtgctaggattacaggcatgagccactgtgcccagccctctccatgaacattttctaattaaacttgacacttaatacaatgttatgcttaggactgctataaagcttacctctggagttgcgcagcacaaaggccttggtgtgtgtataaatttggtttgttcttttcacagcaaaagctacccacctttgcctcctgtgcctgcttctgcccagggacttaggtcctcttacaccttagagaaaggccttagcatctggtcacaggcagatgagtgacagcaagaaaacctggctgcaatgtaattttgtttccatcctctttattagttatcaattggatttttatgaaatttccaagttccactcaaggatttctcagtgtttttttactttggtatagtggaaaccagggttgccagaaagtattattttgggggtgagttagtcaaccttcgttcagtcagacagacaggagcacctcagcaattcccagaaacgggctgatgggaaagagcaacatacatgaatgtcttgaagaacacagccaacagagcccattgggcagttctgattttccaggtacacagcatctccacagtctcttctgatttttattcccctgagtatatggattccagctcagcatgtagcctttccctgctgagtctctaaccaggataacatgtatttttttgactggatgaattatcttcccatctcttgacatttacagtaattaccaccaagtatggtattttcagtggccgtgattatcagttaccaacacagaattaggatgaagggaggaagggagggaaggaaggtgggtgttttttcacacagtgtcttagccagcaatttagcaaattaatggaaattagatctttgatttttttttctttcaagcattttatttgagagactatcaaaccttataccaagtggccttatggagactgataaccagagtacatggcatatcagtggcaaattgacttaaaatccatacccctactattttaagaccattgtcctttggagcagagagacagactctcccattgagaggtcttgctataagccttcatccggagagtgtagggtagagggcctgggttaagtatgcagattactgcagtgattttacatctaaatgtccattttagatcaactggaatggatggtacagctgtgtggtgcttctgtggtgaaggagctttcatcattcacccttggcacagtaagtattgggtgccctgtcagagagggaggacacaatattctctcctgtgagcaagactggcacctgtcagtccctatggatgcccctactgtagcctcagaagtcttctctgcccacatacctgtgccaaaagactccatctgtaagggatgggtaaggatttgagaactgcacatattaaatatactgagggaagactttttccctctaactctttttcccatatgtccctccccctcctctctgtgactgccccagcatactgtgtttcaacaaatcatcaagaaatgatgggctggaggctgggcatggtggctcatgtctgtaatcccagcactttgggaggccgaggcaggtggatcacttgtcaggagtttgagaccagcctggccaacatggtgaaaccccatctgtactaaaaaaaaaaaaacaaaaagtagccaggcctggtggagcatgcctgtaatgccagctatttgggaagttgaggtgtgagcatcgcttgaacgtgggaggcagaggttgcagtgagccaagattgcaccactgcactccagactgggtgacagagtgagactttgtctaaaaaaaaaaaaaaagagagagagagaaaagctaggtgcggtggctcacgcctgtaatcccagcactttgggaggctgaggtgggcagatcacgaggtcaagagatcgagaccatcctggccaaccaacatggcgaaaccccgtctctactaaaaatacaaaaattagctgggcgtaggggcgcacgcctgtagtcccagctacttgaggggctggggcaggagaatcgcttgaaccccggaggcggaggttgcagttagccaagatcgcgccactgcactccagcccgggcgacagagcgagactccgtctcaaaaaaaaagagagagagagaaatgatgggctgggccagtgccccacccctgtaatcacaacactgggaggccaaggtgggagaatcgcttgagcctgggagctgaagaccagcctgggcaatacagtaggacctcatgtctacaaaaaaattattaaaaattagccaaggctgggtgcggtggctcatgcctataatcccgggggtgaagttgagcccaggagtttgagaccagcctgggcaacatggcaaaaccctgtctctaccaaaaatacaaaaaaattagccaggggtggtggtacgtgtctgtagttccagctacttaggaggctgagatggaaggattgcttgagcccaggaggcagaggtggcagtgagctgagatcacaccactgcactccagcctgggtgacagagcaagaccctgtctcaaaaacaaacaaaaaaaatgatgaagtgacagttccagtagtcctactttgacactttgaatgctctttccttcctggggatccagggtgtccacccaattgtggttgtgcagccagatgcctggacagaggacaatggcttccatggtaaggtgcctgcatgtacctgtgctatatggggtccttttgcatgggtttggtttatcactcattacctggtgcttgagtagcacagttcttggcacattttaaatatttgttgaatgaatggctaaaatgtctttttgatgtttttattgttatttgttttatattgtaaaagtaatacatgaactgtttccatggggtgggagtaagatatgaatgttcatcacaaaaacataaatcaaggccgggcatggtggctcatgcctataattccagcactttgggaggtcaagatggaggtcaaggtgggagcctagaagttcgagaccagcctgggcaacataaggagacttcatctgtacaacaaatttaaaaagtagctgggtgtggtggcagatgcctgtagtcgcagctacttgggaagctgaggtgggaggatcacttgagctcaggaggttgatgcttcagtgagccacgatcacaccactgtactccagcctgggcgacagagcgagaccgtgtctcaaaaagaaaaaagaaagtataaatttacacaaaaacaataaaataatcccagtaattccaccacttggagatgatcaccataaaactccaccaggcatatgtgcgtatatatacacgtgtattttataaaatgtgatcataattacactgttttgcttttttccttaagatattacatacatttttccacatcgttaaattacagtgctgttttcctggtggctttcctttaacagattgaagttcatgttaatacagttgccagaggctgtgggctttcactgtcaccaggagtcactcctagggcctcttcagagcaaggccttatgtcctgaagcattgccttttttttttttttttgaggtggagtctcactctgtcacttagcaggctggagtgcagtggcccagtcttggctcactgcaacctccgcctcctgggtttaaatgattctcctgcctcagcctcagggcggatcacctgacatcaggagtttgagaccagcctggccaatatggcgaaaccccatctctactaaaaatactaaaaaaaattagccaggcatggtggcacgcacttgtagtcccagctacttgggagactgaggcaggagaatcgcttgaacccaggatgttgaggttgcagtgagctgagatcacaccatcacaatccagcctgagtgacagagtgagactccatctgaaaaaaaagaaaaaacaattagcctggcatggtggcaggcacctgtaatccctgctacttgggaggctgaggcaggagaattgcttgaacccgggaggtggaggttgcagtgagctgagatcgtgccattgcattccaggctgagcaacaagagcaagactccgtctcaaaaaaaaaaaaaaaaaaaaaaaaaggccaggtgcagtggctcacgcctgtaatcccagcactttgggaggccaaggtgggtggatcacctgaggtcaggagttccagagcagcctggccaacattgtgaaacccccgtctctactaaaaatacaaaaattagctgggtgtgatggcatgtgcctgtaattccagctactcaggaggcagagacaggagaattgcttgaacccaggaggcggaggttgaatgagccgagattgcgccatcacactctagcctcggcgacagagcaagactccgtctcaaaaaaaaaaaaaaaaaaattagcttctacctcattaatcctaagaactcatacaaccaggaccctggagtcgattgattagagcctagtccaggagaatgaattgacactaatctctgcttgtgttctctgtctccagcaattgggcagatgtgtgaggcacctgtggtgacccgagagtgggtgttggacagtgtagcactctaccagtgccaggagctggacacctacctgataccccagatcccccacagccactactgactgcagccagccacaggtacagagccacaggaccccaagaatgagcttacaaagtggcctttccaggccctgggagctcctctcactcttcagtccttctactgtcctggctactaaatattttatgtacatcagcctgaaaaggacttctggctatgcaagggtcccttaaagattttctgcttgaagtctcccttggaaatctgccatgagcacaaaattatggtaatttttcacctgagaagattttaaaaccatttaaacgccaccaattgagcaagatgctgattcattatttatcagccctattctttctattcaggctgttgttggcttagggctggaagcacagagtggcttggcctcaagagaatagctggtttccctaagtttacttctctaaaaccctgtgttcacaaaggcagagagtcagacccttcaatggaaggagagtgcttgggatcgattatgtgacttaaagtcagaatagtccttgggcagttctcaaatgttggagtggaacattggggaggaaattctgaggcaggtattagaaatgaaaaggaaacttgaaacctgggcatggtggctcacgcctgtaatcccagcactttgggaggccaaggtgggcagatcactggaggtcaggagttcgaaaccagcctggccaacatggtgaaaccccatctctactaaaaatacagaaattagccggtcatggtggtggacacctgtaatcccagctactcaggtggctaaggcaggagaatcacttcagcccgggaggtggaggttgcagtgagccaagatcataccacggcactccagcctgggtgacagtgagactgtggctcaaaaaaaaaaaaaaaaaaggaaaatgaaactaggaaaggtttcttaaagtctgagatatatttgctagatttctaaagaatgtgttctaaaacagcagaagattttcaagaaccggtttccaaagacagtcttctaattcctcattagtaataagtaaaatgtttattgttgtagctctggtatataatccattcctcttaaaatataagacctctggcatgaatatttcatatctataaaatgacagatcccaccaggaaggaagctgttgctttctttgaggtgatttttttcctttgctccctgttgctgaaaccatacagcttcataaataattttgcttgctgaaggaagaaaaagtgtttttcataaacccattatccaggactgtttatagctgttggaaggactaggtcttccctagcccccccagtgtgcaagggcagtgaagacttgattgtacaaaatacgttttgtaaatgttgtgctgttaacactgcaaataaacttggtagcaaacacttccaccatgaatgactgttcttgagacttaggccagccgactttctcagagccttttcactgtgcttcagtctcccactctgtaaaatgggggtaatgatagtatctacctcctaggatttattgaggcagcttaaataccttttgtatttcctgttgctgccaaaacaaattgttgcaaggtcagaagtctgaggtggctcaactgtttctttgtttcaggtttcatgaggccaaaataaaggtgttcgcagggcgtgttcccttctagaggctctgggtccttgcagttctaggactaagatccctgtttcccactggctgttggctgggcatcattctcagcttcttgaggctccccacattcctaggctcctggcctgtctgcctccatcttcaaaaccagcaatgggtggtcaagtttttctcacactgaatcttgctgactactgtatctttctaactcctgccagagacatttctctgtttctaagggctcaagtgattagattgcacccacttggtaatccaaagtgatcttcatatcttaaggcccatagccttaattatagctgcaaagtcccttcgcagcagtacctagattactgttggaatgaataaccagaagacagcaatcaagggaggacatctttagaattctgcctaccacttgtatttaacatgcttaatccacagatgacactctctaccattatttcctggtcctcacactgctcagagattggaatcctttttaagcaaagagaatgaagtcatcacatagttcagtcctgctgtatttgctggaaacagtgaaggaagatagagaaaatggagctaactgccaatattaccattttataatcagtcctcaatcatagccctatgaagtgggtatttgttacctcattggaaaaatgggagttgaatctcaagttccttgtttgtaagattttactcagatttgcacagctaaaaatgactacatggagacccaaagccacctttctgttcccatcatcagctttccatctgcctctgtcactgaccccgggacagaaggttcaagccttaagggaatttggagagagaactagattttgaggggaactcacactcacttcccttttgggccacagtaggagacagtaaaagcagccccatgtcaggcaaagggtcttacaggagtggatcatggctgctgtttccacttctctctggcttcccagcttatgactgtgtatcttagttgtcaaagccttccagttcatcctcacctacagcttgacttcccaagggcccatgccagctccctgtctacctgccagtgagttgatgagtctcggtgttagtagtaaaggcaggcgggaagcaagcagaagtgctactgggccttgagggtaagccaggcctcagccttctgaccccatcactaatgggttaataggaaaagcagtatccatctagtacagcctgccttttcaggaatagtgagtaaaagcaaagatgactaaaatacattaaagttttctgtaattgtctctaaggtctcccaacaaacatataccccatctgtttcaagctctgcataacctttcccagaagtcaagttcaggccctggcctcatggtgcctggcccaggttaagagtgctacctgatgatggagttaatacacgttgctttgacctctgactttaagatgtcctcccacttttccaccccgcaatctctagccctctctgggcacagcagcaattgggaactagttcctgtactgcctttatctcattttacaaaacaaacttctacaaagaagctggaaaggaaggaggagaaaggattatcatgcaggcacagggagggggcctagagaagagctctggcagattatgtccctcttaaaaaatgcaaccagaatcatcaacaaagtatcacctcaaaaatatgcaggagaaaaagaaaggaatcaatgttggggtggttggagcagaaggagccaaactgcccagaaggtgtcctctgaaggctgcgaggagcagactaggtcagccccagaggcagatggcacacacagaatggcaggattaccggtagctgcagatttattgacagaagccctagagactgggcctgctgcccagggaatgtgggggctcacttatcaaagactactggaaaatggctgagccggcaaccccttccactacagtgatgcctggttttcttgcacagcctgtaactctgcctgtaacaaggagaaaattaaagcaacgaatctggccaaatagaaaattaaggaaaactagaaacagctcctatggagagcagggattggggaggtgtagaggggctgatcctgaatgtctggaggatcaggaaaatgtaagcaattgtttaagggactggtaggaatcaagatctggagagagatcctcccgactctggtggctggggaatatgaactgtggagacatggtttcaaggactcaaaatgatatgacagcttaacatttacagttcagtgcagaggctctcaaagcatgatcccctgataggagtgtgagggggcaacaccatcacctaggaatttgttagatatgcaaattcccagacccactgaatcccagacaggtggggccagcaacctgtgaatctacaacaggctcaagtttgagaacaaatgacttagtgtaaggggctgctaattgatataaaatgttacctgtggtctattattttgtctgtagtgaatattgggcttgttaaggataaataaggtttgtgggctggtaagtggttcttctctacaaggttgcaacagctggcttcagttaacttcaaaaaggccctttaagcaaagacagtagtccccccactcatccatggttttgatttcagttacttatggtcaaccatggtccaaaaatattaaaaggaaaattccggaaaccagtcactcgttttaaattgtacaccattctaagtattgtttgacttgttctattttattattagttattgttgttaatctcttactgtgcccaatttataaattaaattttatcataggtatgtatgtatagggaaaaacataatatatatagggtttggtactatccgagggttcaggcatctacttgtggtcttggaacatatgccccgcagataaggggggactgctgtacaatgcaaaggacaaagattaaattatattagcaatctaggagcagaagggcaagactgcttttttaaaaaacagctaaaggtttaggaggttttattaatatttaaattgtattgaaaccacagctgcagcctttgactccagcatagagatatgcaaatatggctttcaaaagaaaggcaatttcagacagccctcaaagtaacaggaacaaataaaacaaatgattttgtaatttatctttattgactgatgttgcacaaggcacaggccataccctgtgagagtcagcaacagccgagctctctgaggagagaagagaaagccaggctggagggagaggcaggccgacccatagacaggtgacaggaaagacacagagcaggcagatgggagaagaagacaactaaattaaaagggaaggaaaataaaaacccagccctgggtcctgtagaccatctgatcttgctggctctcagcagcaacaacaataatcattaatgactatcatttgccacactactactaagtgccatgcactattcctcacatacaaatgaggaaaatgaagctttgagaggtcaagcaacttacccaaggtcacacaacaaaaggaaggggcagagcccagattcaaagatttgtgtgaggctgaagccctgtgctctttccagtgcattatgctgggaaccagtcctgggaggcagtgaataacaataaggttaatgggccgggcgcagtggctcatgcctgtaatcccagcactttgggaggcggaggcgggcaaatcacgaggtcaggagatcgagaccatcctggctaacatggtgaaaccctgtctctactaaaaatacaaaaaattagccgggcgtggtgtcgggcacctgtagtcccagctactcaggaggctgaggcaggagaatggcatgaacctgggaggcagagcttgcggtgagccacgatcgcgccactgcactccaacctgggtgacacagtgagactccgtctcaaaagaaaaaacaaaacaaaacaataaggttaatgattgaggggacactttgtgcccagttctgtggtattctgtatgggcatgcgtgtgtctgtgtgtgtgtatatgtatgtaactgtggaaaagagggtgaaaacctccatttctgaccttcaaattggttactatccaatgagtaaggcaagaaaagaaagccaaagaaaacttgcagaattctggtgtaaaagttcttttggggccgtgtggtggggccagctctgcctgttgtggaagacttctggtggaggcatctcagctggccttggccttgagtaaaatttagccagatgaaaaggaaagctggagattacacaggcccaggtgagagcctccagctgctagaattggaggaaggagcacctgattcagagagatgagaaaaggcaagagaatcctgaaaggatacatatctctgaccctttgtccccatccaatctccccagaccttccatcccaagcccaaacacaaccttacctgctgctccttttcaggcaccctggccaccaaatataggaacccataaattttgctcatactctatgttctactaggcaagtcctgatctgtcatctctacaggccccaatccttcccgctcacccctacagagccttctccaggttttctaggccagaatctctccccacttagaatactccagaagttttgctttatttgtgagactttattcaattgaagttacttgtgtgcatatgttatcctctctatttgactagaaggtccttataatcccttatgaccataattattttatctttgatataacccagctctgtaactagcagatactttgttaggcatccagtgggtttttcctaaatgaatgaagtaaaggatgaatgaatggactcagtgcattgaagggcttatccaactattggttccactctcaagacctttggaaaactagccatgttctggaatgctaattcccttcaatgcctttcgcccatttttctatgaccctgatttactccaaaaacaatataagggatctaagtgtccaagaatgactccttctaaacccacacctaaggattttctctctttttgtgtgtgtgtgtgtgagacagagtttcactcttattgcccaggctggagtgcaatggtgcgatctcagctcactgcaacctccgcctccagggttcaagtgattctccctgtctcaccctcccgagtagctgagattacaggcgcctgccatcacacccagctaatttttgtatttttagtagagacagggttcaccacgttggccaggctggtctcgaactcctgtcctcaggtgatccacccaccttggcctcccaaagtgctgggattacaagcatgagccaccacacccggcctctttgattctcttttgcctatcatgaagtctacccctttgtaattaattagaccaatgtccacccagacagaataacattttcccctatccatcagcgaggtcttctccgtgatggacattcaaggcagacagagagactgctgctgcaataactggggaaataattatggtgttcatgatgatttctttgcaggttcaaagcactagcccagccattatctctcccacttcactaggataaaattgctaaccccactttataggtgctaaaacaggtccagggccttgtcaaaggtcactcagtgagctggtggcagacctggaaataactagcctaggagtctcgatattcattaggccacagatggaaatgccctcattatgctgtctgggctatgtctgagagagagtcaactaactggactccagttaaatggagatatgcactggaagataagtttgtgactacagagtgtttttctctgcaatgctgcagcagttggcactggttaattccagagggtgtgtgtgtgtgtttgtgtgtgtgtgtgtgtgtgtgtgtgtgtgtttaaagcattatcacgcgtcctagatgagggaagagagggtgaatccaaggtaacacagacacacaggtaagcagatgtttgccatcttctcttgaaagtcatataaaaccaaatgacagtgtatattagcaggagaaactcaggaggctcttcccagctgttaggctatacgactctggaataagctagtacaaattaggtagaaagtctaggattgttcctagagcctggtggcgggaggtctttcctggaggcaaaggactgtggggctgtctcagggccttctgcagctgctaaagtgagaagcctgccgacgggatcatccccaagcccacagaagctctgaaagctatggaaaccaagatctgtacaggagccacttctggtttctaatgcctgagagattaaaatggaaaaaaaaattcccatggaaattcaagaatgcaagaatgttctggggccaggcacggtggctcatgcctgtaatcccagcacttttggaaggccgatcacctaagatcagaagttcaagaccagcctggtcaacatggtgaaaccccgtctctattaaaaatagaaaattagctgggcgtggtggtgtgcacctgtaatcccagctactcaggaggctgaggccagagaatcacttgaaccctggagccagaggttgcagcgagctgagatcatgccattgcactccagcccaggcaacaagagcaaaactccatctcaaaaaaaaaaaaaaaagttctacaacgtggccacaggtccgttctggctaaggcagtgatgtccccctcccaccaaagcccaaaccttctaacatcatcctaaagtgtgggaatcacctcttcacctcaggccagctctgggcttttctcagcctattcatcagcctccattagtcctcagctctgctgaggcctcagcagcttcccagtcccactgaaggctgtggggcatagaatgggcagagggcaggccgggcgtggtggctcaagcctgtaatcccagcactttgggaggccgaggcgggcagatcacgaggtcaggagatcgagaccatcctggctaacacggtgaaccccatctctactaaaaatacaaaaaattagccaggcgtggtggcaggtgcctgtagtcccagctacttggtaggctgaggcaggagaatggcatgaacccgggaggcggagcttgcagtgagccaagatcctgccactgcactccagcctgggcgacagagcaaaactccgtctcaaaaaaaaaaaaaaaaagaaagaatgggcagagggcataaaacctgagtccagaggtggtggttgcacaacattgtgaatgcactaaatgcccctgaattgtacattttaaaatggctaattgtatgttatgtgaatttcaatcgatttttaaaaaaaataaaactgagccacctttggggtggggagaggagctgggccaggctctgaggatttgagggttgaaactccttgcagggagtgaaatgaacgacaatggggaggccagtctggccctcccaactcctcctccaggaccagatgggaactggggctagggagaaaggcccaactggggcggcgccgggctctgggcagaagagaagcactcagtgaatgtgaggaggctgcagccgtcggctcatttgcatcataagtgattggttttccctgctcgtccctcatcaggacacaatggacagttgtttgctggcgcagcagatccatttaccaagggagagaggagacagagcacaagtgaccgatgggtaatagtgttgaagggtgggcagccgcctcccctcccctgtgctcccaggccactgggactcttgttctcacacaatgagaagggaccttagagagcaaatcaccgcttcactttatagaagaagagactgaggtgctgagaggaggtgagccttgctgtggtcaaacagcaagaacatagcaaaactaagcattttaaactctaacctctggatcctttttctttgagacaaggtctcgctctgtcacccaggctggagtagtacagtggcacaatctcagctcactgcaacctctacctcccaggctcaagtgatccccccacctcaactttctgtgggccacgacacctggctaattttttgtagagacaaggtctcactgtgttgcccacatttttctcgaactcctgggctcaagtgatcctccagccttggcctcccaaagtgctaggattacaggtgtgagccacagcactgggcctgtttggtttttgttttgttttgtttttttgagatagggttccactctgtcatccaggctagagtgcagtggtatgatcactgctcactacagcctcacactcctggttcaagtgatcctcccacctcagcctcctgagtagctaggactataagtatgtgccaccacgcttagctaatttttatttcttttattttttctagaaacagtgtttccctatgttgcccaggctggtctcacctgggttcaagtgatcctcccacctcagcctcctgaatagctgggattacaagtgtgagccactgcaccaggcctggattctaaactgtcatttgagggttcacttcgtttccccataataccttctctgtgcccttattcccatctctgtggtctcctgttcccggggccttcgtttccatcattctgtctcctgggtctatttctttttctctgtttctgttcctctctgtatcttttcctcttggtttccaggcagctaggataattactagacttttaattaacccctgccctaacaaaggtgggtctggcatgaggcagcaatttagcaagtgtcttggtttgttttggggataggtggggagagaaaaatatgtgttggggcctattataaaccaggcactaagacagacacataatgcactttatctcatttcatcctttcaatcttgcaaggtaggtgttcttagagacaaaaagggtgaggctcagagaggttaagtaacttgtgcaagggcacccagctagcaaattgtagttacctgactccaaaacctctgttcttccatctcacaccctggcacagggtctaactcagggtaaggggctcattgatttcaggcgcaagggaggcacaaagtcactgaaggagaccactgttttgttgctgtcctctaggcagcgactgcgtccccccagagccccctccttctctgagccccttctgcagcgtggcgaaatctcacaaatgcaagcttttgcccccagggaggtggggaggcagtgatcaagaaagaaacctgacaaacccagaccaaccatgggggtctccctcctgttaacacccctccctaacagccctcctggtggttccctgtctgcccctcccctttatgggtcaagcctgctggcgtctgtttcattgtgctgtgggggaaggggagagtcaggggtgagtgggtgtctgtgtgcatgaacataaggcctccgggttcattctgacactgaatgaaaaactcaccaattattcgtccagtctcattaatatgcagacagacatctgttatttaggagtcaacagcagaggcattttcttgtcgggaggggcactagtgtacagggctctcttgtctctccgctgctagcgggtagctactcaggaatcatcccacacctcccgacctggagcctcccctctctctgaccctcactcacagctttgaggacagcaagtaagggattgaccagacagagatggagggagatctgggaacctggctggaaggaaggaagcaggagaggagctgccttgtgtagaacaaactgagaacaaaacgctaaaccctttcctggggaagagaatgtggagttgggggagagagctgtgccaagagtgcctgccccactgggaatctcagggacatgacccctccccccacaccttcctcagcctgcaggacaagtctgagtgcatctgaagcagggagagggtcactatggcaacatgaagtcctcacccagagactgcagaaaacgtaataagaggagttcagaaaaatggagaccaagggacctcaatctttttttttttttttcaatttatttatttttttttattgatcattcttgggtgtttctcgcagagggggatttggcagggagggacctcaatctttggaggagtcactaaagctctcttcaggccccaagataggggtgggaacaagacataaccacctcctgctttctgtcttctgtcttcctccagcctttaagtcccagcacaaaatacccctccaagaagcctttcccaactccctcaggcccagcttagaagcacttaagccttggtgtcttggttgtaaagaataaaagttgacatcagctgagcaacacaatgaggtagatgtggtgatcagcccccttttctaggtgcaaaaactgaggttcagagaggtgctgggcctcaccaaagattccccagggaagaagcagcagagctcaacccaggccctgggacttctgcctctgaacctgaagctcttcccacgactaccccctgggagggccagagtcacaaggggaggacccttgtcagctgaagtgtttcaggagtttgattgagtcctctcttcccatccaccctgtccttccccctcctccctcctaggcaggcggattgcctaggttaagaaacactagtctgggcgaggtggctcacgcctgtaatcccagcactttgggaggccaaggcaggtggatcactaggtcaggaaattgagaccatcctggctaacacggtgaaacctcgtctctactaaaaaatacaaaaaattaggccgggcgcggtggcttatgcctgtaatcccagcactttgggaggccaagacaggcggatcacgaggtcaggagatcaagaccatcctgactaacacggtgaaaccccgtctctactaaaaatacaaaaaatgagccggacgtggtggcaggtgcctgtagtcccagctactcgggaggctgaggcaggagaatggcgtgaacccaggaggcagagcttgcagtgagccgagattgcgccactgcactccagcctgggcgacagagcgagactccgtctcaaaaaaaaaaaaaaaaaaattagccaggcgtggtggcgggtgcctgtggtcccagttactggggcggctgaggcaggagaatggcgtgaacctgtgaggtggagcttgcagtgagccaagattgggccactgcactccagcctgggcaagaaagcgagactctcaaaaaaaaaaccactagtctgggcgcggtggctcctgcctgtaatcccaacactttgggaggccaaggtgggtggatcacctgaggtcaggagttcgagaccagcctggccaacatggtgaaaccccatctctactaaaaatacaaaaattaggtcaggcatggtggctcacgcctgtaatcccagcactttgggagactgaagcaggcggatcatgaggtcaagagatggagaccatcctggccaacatggtgaaaccctgtctctactaaaaatacaaaaatggctgggcacggtggctcatgcctgtaatcccagcactttgggaggccgaggtgggtggatcacgttaggtcgggagttcaagactagcctgaccaacatggagaaaccccatctctactaaaaatacaaaattagctgggcatggtggcacatggctgtaatcccagctacttcaggaagctgaggcaggagaatcacttgaacccaggaggtgaggttgccgtgagccgagatcgcgccagtgcactccagcctgggcaataagagtgaaactccgtctcaaaaaaaaaaaaaacactaaaattagctgtgcatggtggcgcgcgcctgtagtcccagctactcaggagactgaggcaggagaatcgcttgaacccaggaggcagaggttgcagtgagccgagatggtgccactgcactccagcctgaatgacagagtgaaactccgtctcaaaaaaaaaaaaaaaaaaaaaaaaaaaacacagaaactctggcagccatcacagtgtgattatttgtttatttcattaaatgtttaacgaggctacattgtttcccaaaccaatgtctaatttgtgaaggaaacagcgcagagaaggaagctgggtgactcctgcatctggggtggggaagggagtaaggtcccctccctccatcctacagaggcctttgaggatcagcaacagtcccattccctcctcccacccactgagctcctcagcccagagccctcctccccagaaataaaacgtctggcaacccagacctgcagaaagggaccaaaaatccattcctggtggtattgaaaatgtattaaactttggggggtcctccagctgattgatttttctaattatgtttgctttagatggatatttaaatgcatttgcattccctgagctcacatggcaggatatggaggttggaggaaagagggggcacaaacactccacactctgcactttggtggttgcaggcttgaacctgctatacactgagaagtccaaagtggaaaagagaagccactcagctaaaaatcgcaagtcgatttttatggcaggtccttgtggggaaagggtcagtcctcagagacagatggagatccacctagctgggcctggagcccctgccctctcctgtacccttagccgaggactcagggtctttgagtcagtccctaaccaggtctcagtttgagggggtggttatccaagcacacttagataatttcaaatgccattgaagttatcctagaatctttgagactggctgagatgaactagtcccataggagaggttgggatagggatatctgatgatccagggagtggtgggtagggattcctttcctctcaagactggaacctggcataagggaaaggagaagctattttttattttttattttttaattttttttagagacagggtctcactctgacactcaggctggaagacaatggcatgatcatagctcactgcagtctctaactcctggcctcaagcgatcctcccagcttggcctcccaaaggaggaatcttggctgggattataggtgtgagccactgccgagaagctattattttaaatgacacacctcagagccaaatctcccagctccaacaccacatccagataaccatctatccaaaaaacaactctgatcacttcactctctgcctgaaattcctggtggcttcatcctctgaggatgatttcattcatcctcagaatgaaattctgattcctctgtggaccctgcagtagcctcagtgtaccttcctagccttgtcttctattctccctgccatgggagccccaacagtgctatgctcattctcatctccacgtgtttacacatgctgtaccctctgcccagagtgcctttcctaccccttccctgcccggaaaactcctcttcaaccctcaggacctggctcacaggactggcttctcaggctgcaaggagctcccatagcatcccatacatgtacaaatatccctcagccatggcaccctcacacctgaggtacctctcttccacactgggctggcctccaaaagcttagagactggtccttgcaatctcccaagccagtgtatgccacacagttggtgttcagtacatacttgctgaatgaatgaatgagggaggaatgggctataaatttgggtgggatcccagcagatagttgggtaaggtcagtgttctcttccagtgtgtctgggagaactggctagggctgggggagggaagggccagggatggttcctgggggagaatgtcaccgaaaagaggccagtgggaccagagccaggaagggaatacaggacaatctgaaaccagactcccgagaaaacagaccagtactgtctttcctgacaacaggcgctcagccgtcctctccaccgtctttcctttaagggacagggtaggggtgactctaacagctgatgctcccctgaaagccatcatgaaactcagcatgggaggagagaaaggtccctggcctgagcctctaaggagaccccagaatcaaactactgacctcttaggaaacttcacgctgtacaggggtagcttctgtgatgtggaggcttttgatgccttcttttttttttttttttttttttttggagacagagtcttgctctgtcatccaggctagaatgcagtggcgcaatctcggctcactgcaagctccgcctcccaggttcacccgggttcacaccattctcctgcctcagcctcccgagcagctgggactacaggcactgccaccgcgcctggctaattttttgtatttttagtagagatggggtttcaccgtgttagccaggatggtctcgatctcctgaacttgtgatccgcccacctcggcctcccaaagtgctgggattacaggcgtgagccagcgcgcccggcctgatgcctccttatccccacaacccccagggtaccagcaggctccaagccaggggtacagatggtgagcaggacccctcccacactagcagcaggcctggctgggctgagaaatgctgactaattatatgtcggtctgctctaaaaccccctaatggcctgagaattgcccacttcattaactaggatgaacagtcccaggatgtctccttctcccaactctgactcctaaaaggacacttctgatccaacctatggctttgtcctctgctctatctgtggacatggacaggaaagttccccagctgaggtctaactttccctcttactgctaaagattggtagattgatttttttaaaaagcaacaaaactaaagccacagccgttttccatggaggtgggctttattaggtgactgttgaggcaagggaggttctagggctggtggactgatggggggcaagggcttctccttgcttttgaatttagtgcatgttgcctagaggttagatgtgtgagaatagctgcagaagtgagaggagaggaaaagagaaggtcatagaatggacattttccttgggccagaaccaggatatggggactgggggtggagagggagggtactcttcacataggagactccaccaaggtcaccatttgataccagcttccctaacgcccacctgccccatcccagttcatgccccagatgccagccctgttagctccctcaacatccactggagaagaggagggaggaggagatgagaaacgatgatacccttctgccctccagctcccctgcccagaattgctcgctctgcctgccctaacttcccagccaggatcaggaggtcaggaagcctgggcgcaggcaggggaacaattgtgtccctcaccacccctcttcacactctgccctctcctagcccctcacatgaggttgcagcttttggctcgatccttgtgtatctcgccctcattcccccggtctggccgtcctgacagctgagcggatcgctgcattccccggcgtgagtcagttcggcgcagctgcctatggccacggccaagggaggccactgtagccacatggaagacatccctgacgctgcgctcagaggaccgggaggagcactcaacataggacacagcccccacctgcttggccagcacagtgccctggaaaaggaaggagtgcatgggagaaagttataggtcttagcctgcagcttagaaaggggcatggaggctgtgggctggggttgaatgtcaaggctgggggcagtcaagggatcaggtcagaggtcacagaccagaacaaaggatgagccaggtaaggtgttttcaaatcagagactgaaggggcagaggtgacaggtctaggctgggatgaggtcagacgtcaagggtcccacctgctcatgtgtaacagggataagcctctgcttggacagctccctcagtgtggccaggtcagtccgcatgtccagtttacagccaaccagcacaaccttggcattggggcagaactcttgagtctctccttgccactatgtaggagaagaaaagagaattgtggaggggtggagggaggcacagcgtgagcctttgtgccatgccagcagtgtgccctctcttcctcaagcacgcagaaaccatgtatccctcaggactctcccacatgaggaaggaggtgagaatgctaggcttggtttgagagcaggatggggtgagagagaagcagcggggaggagagggctggcgtgggcctgtggactcttctccctcagtggctatgaagggtctgccagcctggaaacttcccattcccactcgcctttcccatactctctcctgggaacaaatttatcccaccctcccctcccccacctgggaactggggctgccctagctgacttctgtccattcacccctggcttttgtcatggaaactggggcctggagaggaggccacagggctttcctgagctccaggatcaggcttcccatcccatcccctccatctgggactcccactgccaaggagttggaagagcagagaaggaatcctgtgagtgcttctcccttcactcccccacctcccctagctgctgtatccagctctgaggactttcaggaaaggggtggctgggagggatgggggctggaggcaggggtggcagggatgagagcttcactcgctaaccagctgatggccataccccagccatcactccctcctcctggcccatgttatgtcaggaccatggtggtctggtccccctcagtctagctgccctatttccccaggctcccaccttcttgagaacactgtccagtgtttctggtcggctaatgtcgaagcagatgagcacagcatcagaatcaggataggccagaggccggacattatcatagtaagaggaacctgaaggaagacagggcatgaggggcctgagtggatgggaggcctggaagggaatgggagaccttacagatcctggtcaagggatgctgggagcagagaatggaaaagagcaaccattaatacccatcattaatacccatcatggagtctgggtttcccaagtgggggagcgggcagaagggaggtcacatggtgggaaacggctctctgcttccctagtggtttaaaaagtaataatttttattcttgactgaggtttggacccctttgagaagctcataaaatctatagacattctcataaaatgttgcatgtgctttctgggctttggcagtctaaagccctgaagggaactcttgtaaaaataaaaaccctccttatgttgggaggaggaaaagagcagtggcagggagagcactctcccattctcctgggacttgacctcagatttatctagttcaatggagagaaacagcctcctgaccacccctcactcaagacattctaaatgtcttttctgcttttttattttttgagatggagtctcgctctatcgctcaggctggagtgcagcggcatgatctcggctcactgcagcctccgcctcccaggttccagcgattctcttgcctcagcctcctggtagctgagattacaggcacgtgccacacgcccgattaatttttgtatttttagtagagacggagtttcaaccatgttggccaggctggtctcaaactcctgacctcaggtgatccccccaccccagcctcccaaagtgctaggattacaggcgtgagccaccgtgcctggcctctaaatgtcttttctaaacccagtcttatctctgaaggaacatgttccaaattaaaagccattccttcccaactttcccaggtaggcaggacccagctgaggggctcagatcctaggctttctccttcaggacatggtttctgtcaggctctgcaagttctacctcagtttccctggattttagcagaatattgatttttcccttcctgttggaattggatggatgggctgggcttacctggaacctaagggtctaaccaagggaggggacagagtgggccgccttggaagtcagggtgacccccagggacttggctacctgaagtgtcccacatgttgagctcaatgcggcgcttgtcgatctcaaagctcgcagtgtagttctcaaacacggtggggacataactctgcagacacggatggatccagatgagatcatctctccaagtcctcaccccagataaatgccctcctcactcccacaccccgtccagcccagcccctggacacaagttggtctgggattgggcaaaggggagatcccgggagctcctgcccccccccccccccccccggagaatctctgctaagctccaagacctcctcctgttcccttctggtcccttcagccccctagttcttcccctctccattgcccaggacctccgacattcccctcgccctccctcccggatgctctggttctcccaaaccccatctatctcaccctgctccctaattcctcccaccccaatcctctgcagtccttcctgagccctcaaggcctccccgcgtcctccgaccccctgtctcttgtccctggttacccgagtacccattcccatccgtcgccagggcccctgtcacccaccccccagcagccttagcgtccccctcccaagacgcaggtccctcaccccgggataggcgtccttggcgaacacctgcagcagcgccgtcttgccgcactctgcgtctcccaccaccacgatcttgcagcggccgctctgcccctccatggtcccggctacgagccggtcccccacgccacccctctcccggtcccctccttcgcctctcccgcccctgcaactgcagccgctcgggccgccaacaccggcatctcccgggcccgcgccgagcccccgccccgggtccgcggccccccctccgccccgcccccagccagcgccgcgccccccggccctcctcccacccccgcagccggggtcggggccagaagatctggcggagccctgggaacagaggcctcagagccggggtccagcccgccggtgtggtctgaggggcccctgccggtttgggacaggccgaactgggcttatttgactttctcggatataagggcaggtcagagttcaagcgaagttcttaggggtagaatatgagcggcacaagcgcgaagctcgggcctgctgtgtacccacgcgtgcacgcaggtgtaccagtgcggacaagagctggggcagccatccacttcctgaacacggcgggagagagatgctaaggggaaggagggagcctctttggttttctctcccgcgtccgcctatgtcctggcagggggtcttggggaaatgggagggtgaaccccagcacacccacccggacggtggtgacatcatagctttccgtccccatggcaacgggcagccgggtctccggttacattgacttaaccgccggcctagactagcagagaagcgtggactgagttcctccagccaagcactgggtggaaagttttgggggagctgcgtcctctggtggatgcttggggacaaggagataaggaagagaaagaaccaaccgccagagttgctctgctggagccagagctaaacccaaaagtcaggcttgattaagagtctgacaataggccgggcgcggtggctcacgcctgtaataccagcactttgggaggccgaggcgggcggatcaagaggtcaggagatcgagactatcatcctggctaacacggtgaaacccgcacggtgggcgcctgtaatcccagctactcaggaggctgaggcaggagaatggcgtgaacccgggaggcggagcttgcagtgagccgagattgcctcactgcactccagcttgtgcaatagagtttcgaaaaaaaaaaagtgcttttttatatcgaggcaattcgagtcaataatatatgctgcaaataattctgtaaagataactagaagctgggcgcggtggctcacgcctgtaaactcagcactttgggaggccaaggcttgcttgcgtgcaggagtttgaggccatcctgggcaacattagcgagaccctctctctagaaaaaaaaatcaaaacttagctaggtttggccactctaggcacgctgcctatggggtagccctgctctgcaaagagcagtaaaacataaagttagccgggcgtggtgacacatgcctgtggtcccagctattcaggaggctgaggtgggaggattgcttgaagccgggagtttgaggctgtagggagctgtgatcgccccacctcgctcagcctgggtgacagagtgagaccctgtatcaaaaaaataaaaatataaatataactagagcacgcagcatcatcactatgttacagaagggaaaatgaggaacagaacgttaacaccaaagtcagaaagttttaaaggcttggtctccatgcttctactttgccactgcaagaccacagtgaattaagtctcatccctgcctgggttagatgtcagagcctgagacacaatgtagttggactccagtccacaggtggctgactccaaatctgatatgagttaactccaaatctgatgtaagttcaagttttgggactgttccttaactttttttttttttttttgagacggagtctcgctctgtagcccaggctggagtgcagtggcgcgatctcgactcactgcaagctctgcctcctgggttcatgccattctcctgcctcagcctcccaggtagctgggactacaggcgcctgccaccacgcctggctaattttttgtattttttagtagagacggggtttcaccgtgttagccaggtgaatctcctgacctcgtaatctgcccgcctcggcctcccaaagtgctgggattacaggcgtgagacaccgcgcccggcctttttttttttcgagatggagtctccctctgtagcccaggctggagtgcagcggcatgatcttggctaactgcaacctccgcctcctgggttcaagcaattctccagcctccgcctccctagtagctgggactataggcacctgccaccatgcctggctaatttttgtagttttagtagagctggggtttcaccatactggtcaggctggtctcgaattcctgacctcaggtgatccacccacccgcctcggcctcccaaagtgttgggattacaggcgtgagcacggcgcccggccctttttttttttttttttaacagggtctcactctgttgcccagactggagtgtagtggcgcgatctcggctcacctccgcctcccaggctcaagcgattcctctgcctcagcctcccaagtagctgagattacaggcgcgcgccactaccgcccggctaacttttttatttttagtaaagacggggtttcaccatgttggccaggctggtcttgaactcctgacctcaaatgatccaccagcctcggcctcccaaagtgctgggattacaggcgtgagccaccgcgccaggcctatcccttaaaatagtttttaatttgaataaggtttactatgaataaataaatcacagtcggcttgatcccaagagcacagacgttcctggtgccccttttcgtgctctcccagcttgcgccactatggccctggccctttaaggctgagcgcgaggccccgcctcgcccggcgccccgcccctcccgctggatcccgcagccgcggctcttcccgacgcgttccgacttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccgccactgctgcgctgcctagtgctcaccggctttggaggctacgacaaggtgaagctgcagagccggccggcagcggccccggcccctgggcccggccagctgacgctgcgtctgcgggcctgcgggctcaacttcgcagacctcatggctaggcaggggctgtacgaccgtctcccgcctctgcctgtcactccgggcatggagggcgcgggtgttgtgatcgcagtgggcgagggagtcagcgaccgcaaggtgagcgggttgcgtagggcagggcagggctgcgcaggccactgggcagtggggcacgagtgggcgagcgccgggggtgtggcagggcgggagaaactggcgcggacctgggtgcacgagcgtggaaagcgtagccaaggaacttgtgtttgggggctcctggagagcggcatttatgtggggaggggagacgaaattatcgccccttccccaaccattttaagttgtggccgccgcccagaagctgtgctggtgggggggaaaacaataaggtgcccatgcgcatgcgcacaaccacactaccgtccccacccaccccccccccccccattaaaaccacacctgtacccctacccaccaaacactctctgggtaattgtggtctgtgactatgagtgacggttagtgccccctttccccgagggagcttgaggggctatgtcgtcggggttgggcgggggcacagcggccgtgccagagtcctggtcacatgcagccccgtggtctgtgggggtgtgaggcggcccctcccaaagcaaggccaaagagacgagacacgcccatcacggaggagagagagcctttgctaccccaccgccaccagccttacaccgccgatctgattttggggtgggggaggcgggattgggtcatccgatctttgtcttgggctctgtgtctcccgtgactgcagtatctcctcctcctgtgactcagccctcagccttcgggccacgacccggggctgcccttgggaatgcctggggcggggagtggaaggggggacccacctctgccttcctcctgcagaggacccccacttcagaaaccccagtgccaggggtttggactggaacggagaggtgcggcgccttgaactggttggccaagtctgcaggcctgtttctccttctcatttatcattaatcttggccacaaccctggacaccagagagctcaaaatgatcagctttttgagagacctgggatgaggcctcagcacgccatttgtttagaggtttcttttttttttctttttctttttttttttttttttttttagacggagtttcgctcttgttgcccaggctggagtgcaatggcgcgatctcggctcaccgcaacctctgcctcccgggttcaagcgattctcctgcctcagcctctcgagtagctgggattacaggcatgcgccaccatgcctggctaattttcgtattttttagtagagacaaggtttcaccattttgggcaggctggtctcgaactcccgacctcaggtgatctgcccacctcggcctccctaagtgctggggttacagacataagccactgcgcttggccaggagtttcctttttaaatcagacccctcaatgagaggccccacagatgcagcctcttgcagacctgccagcccaattctggagccaggtttgttggattcatcctgtatgcaaacagcttctccttaaggctttcctctgaattcagctctggccccaccctcaaactgacttctaaatgatcccactcttgagcaggcgtctaagaggaatattttcgggaggtagttgtagttcatgttactgctgaaggccacccacctcacctcccctccatacactttccgcctggtaaatacaggatatcctgtccagggcaagaatctgatgtaagagcctggattctgcggggagggcccttccctctctctccctcctcctccctcctggtgtctgggttggggaggggtcatggccctgatttggatggcctgagggttagcatgagccagggtaagtgagacttgttctgggtcaaatctgggactggccatgaccctaaatgaccaatgcactcctcgcagctctcctgggttgttctgtatctgctagtcctgagtccctgggtggagggcttccgttcttgttctccagacctcatctcaggccagaacttggaaggaaagaccccagcatgccctcagttctcgtattcagtggagtgtgggggcttgaggacatgaaaaagggcgtaagtggcagtcccatcccccttccccatggaccctaactcttgttaatatacagaattcccatcattcctggcagggatcaagacagacccagattgtcccagaacagcacccacacctccctcttcatgctcttcagagagcgcagagaagtcttttctcctgacgctccctccttttccctgcccttcccttgaccccacttgctaagctggagagaaaggttctgttatctttgtcccctttccctcctgcacagaggctctcgtgggggtgggggggaagccttttactgctgcgtaggcctctgtagcccttcttgtctgttgcccctcctgcaccatctctgagtgaagatgttttctgggctcccagtgctggctcaaacacacttctcccgaggtgaccacaccctgctgtaagcgctcagagaactttgtctgcactttggtatggccctgaccacacagtgccgtcttcttttggttgtgtgacttccttgctgctattatattattattattattattgttagctaacattattaagtgcttattatgtgccagacattgtgctaaaattttttttttccatttggaaaaactgccctaattgacagataagaaaactggagctggaaaagtggagctcaaaaagattaagtaatttttatgcatccgaagtcacacagtcagtaaacagttgagaccgcttttgtaaccacagcagtttgatcttttccacaatacttcatgctgccctaactgtaagcttcttgcattcagggatcttacacaatagtgacatgtaagatctgtaagaagatgataaggatagtatctgcctcaaagaactgatgtaagggttaattaagcattatatataaagcacttgaaatcgggctcggccctcagtcagcactcagtaaaggtgagttgttattgttgttgatgatgatgttattattattattaccatgactattgctgcttctcctgctacttcatttggaagaaggtggccttgtacctagggggaaatcagtaaatagcctgtgggtgaatgaatgagtgactgaatgatactcttctgttcttcaaggcaggagaccgggtgatggtgttgaaccggtcagggatgtggcaggaagaggtgactgtgccctcggtccagaccttcctgattcctgaggccatgacctttgaggaagctgctgccttgctcgtcaattacattacagcctacatggtcctctttgacttcggcaacctacagcctggccacagcgtcttggtacacatggctgcaggtgacaggtcccctcactttatcaccccttaccccacccagatttccttccaggccccttccctgcagcctgtctgggttgttgtcatggcaacaccaggctgccttggcctgtggctcccagaggcctctgctgtgtagttgccgtggtaacattcaggcaccaggtctagtctggtgtgctatccttagcaacgtgccctcaccccacacccccacctctctagctaccttccccaccacttctcagtcatggaaattagacacggccctaaaatgagcgtaggcaaaatgaaggtgacaggctgagtccctgggaggctagaatggagtggttggtggccagggcaactccatatcccctgcttatgggtgtcttgctgcagggggtgtgggtatggctgccgtgcagctgtgccgtacagtggagaatgtgacagtgttcggaacggcctcggccagcaagcacgaggcactgaaggagaatggggtcacacatcccatcgactatcacacgactgactacgtggatgagatcaagaagatttcccctaaaggtggggggcataatatgggagggggtagggaggcacaggacagggaggggagctccagatctgtggatcctaatgttgttcttgggttcccctactctatgacaggagtggacattgtcatggaccctctgggtgggtcagatactgccaagggctacaacctcctgaaacccatgggcaaagtcgtcacctatggtgagttagtgggccagggatggagagagcatgtgagggcaggagggagggtctaaggggtgggatatagaggccagggcttttgaatgaagaaggggtagggactcaggtgctctgtagacgatcagggttaggaatggtcctgtatgctgcattcagattgctgactcttgggtaccagctcttttcattctctgtcacaacttttcatatgagtgatagtaaattctacattcttttttttggttttttttttgagatggagtttcgctcttgtcgcccaggctggagtgcaatggcatgatctcggtcagtgcaacctctgcctcctgggttcaagcgattctcctgcctcaccctcccgagtagctggaattacaggtgtctgccaccacgcccaactaatttttgtatttttagtagaggcggtgtttcaccatgttggccaggctggtcttgaactcctgatctcaggtgatccagccgcctcagcctcccaaagtgctgggattatagccgtgagccaccacgcctggccaaattctacattcttgtttggggattattcttgaacaaccagcctgccttctttctgtcctacctccctgagcatcttaggcagggtgcattttcatttaaaaaagtatttcatacaacaaaataagccaggcatggtggctcatgcctgtaatcccagcactttggaaggccagggcaggcagatggcttgagcctagaaattcgagaccagcctggtcaacatggtgtaccttatctccacaaaaaatacaaaaattagccaggtgtggtggcactgtactccagcctgggcaacagagcgagaccctgactcaaacaaatgaacaaacaagcaaatacataaagattagagcaatttttttttttttgagacagaatatcactctgttacccatcctggagtgcagtggcgcaacctcggctctctgcagcatccacctccctggttcaagcagttctgcctcaggctcctgagtagctggaattacaggtgcccatctccacgcctggcttttttttttttctttttcttgagacagagtctggctgtcacccaggctggagtgcagtgacacgatctcggctcactgcaacctccacctcccggattcaagcaattcttctgcctcagcctcccaagtagctgggactgcgggcgcacgccaccatacctggctaatttttgtattgttgtgggtttttttgtttgttttgttttgttttttttttttgagacggagtttcgctctttttgcccaggctgaagtgcagtggcgcgatctcggctcactgcaacctccgcctcccgggttcaagcgattctcctgcctcagacttcctgagtagctgggattacaggcatgtaccaccatgcccagctaattttgtattttcagtagagacggggtttctccatgttggtcacgctggtctcgaactcctgacgtccagtgatccgcccacctcggcctcccaaagtgctgggattataggcgtgagccaccatacccggccaacacctggctaattttcgtattttttagtagagacaaggtttcaccattttgggcaggctggtctcgaactcctgacctcaagtgatccccccaccttggcttcccagagtgctgggattatggatgtgagccatagcacccagcccctagagcaatttaaagtcagccagggttggtttgggcctggtaaccagcagtttgagaattatccaatcactccctggcactggtgtggagaattgcaaggggatcacagggaacagagagcacagatgcagacacacagggatgtgcctgggggggttcacaggctatgtcaccttgtccttcaggaatggccaacctgctgacgggccccaaacggaacctgatggccctggcccggacatggtggaatcagttcagcgtgacagctctgcagctgctgcaggccaaccgggctgtgtgtggcttccacctgggctacctggatggtgaggtggagctggtcagtggtgtggtggcccgcctcctggctctgtacaaccagggccacatcaagccccacattgactcagtctggcccttcgagaaggtgaatgtgaggactttgcagggagggcttgggtaggactcatgaaggctggggtcccaaggggcagattcctggggaagaggagggctgcctgcatcacactggcccctgttggatgagggttggatagcactgggagccgcatctttccttcctccccaggtggctgatgccatgaaacagatgcaggagaagaagaatgtgggcaaggtcctcctggttccagggccagagaagcagaactagggcaagtggctgtgagaccctagagaccagcgaagggagaagttgggaagctacgttctgttggccaccagacttgcatttcagcctctgtcataatgctctgccctccctcccccgaagttctctgtggtgatgaccgctctcccctgcccctccccgcttcctgacctctgaagaggttgggaagtgaccatttggatgtctgggccctgccaaggcgacagggagggtcagagggaggccggctgcttcctgcccccaccctttccccgggcctgctgtgctgcttttgtgccaaggttagccagtcccccctgttgtgttccatgtgctttcacctctgcctcatctttcctcccgtccctgccccgccacctccccaaagaattgaaacgtcagctcaggatatggggccaatctctgtgagtccagcatgtacctgtctctccctagtgtcccttcagcctgggctgaccagtgcccgcctctgggcttgaccagttcccaatctcgtcctctgtccccaacttcttaagcacaattgggcttcttccatctccaggttttctgccattcttaaccaaggctgcctcttccaacagggcgggaatcagacctactcccctaggtcacaactctgggaaggatacagagcccccacccttcactgagttctctggatttgttctcagtgccttagcaacgaaaacctgtgcttgtgtgtgtgtggcggcggggagggaggatcctgtttcccacctccttctcctcccctgtactccccagtgccttccttgttctggtggagctggggtttctctcctccccagtcccacaacactgccaaaaatctgtgtatgtgccattgggtggggcagccccaagcctcctggggaggcagggcaaaaacaggtgccctcatcgtggtctgtgccatgtcccgtctctatggtggttgaggagaaaggcggggaagcttcctcagccttgcagatatgtgtggcatttactagccagagctctgaaaggcagtgctgtctgtttcttgtactgggaccaaagtaaaaatccaagcacattccccttgcagttaggggaggccctactgccttctcaaagcagagaggcagcttatcaaactcagcccaaaactctgtttacatgggtggggagatggagcagggaagtacagagtgggatggtcaggacctgggccattgcaaccaaaatggggacttcctgggtagggaggtcactccctctactcactgagctaggattagggagggttattgccccaaccattgcaatgggaggtggagggacaggctcagcctcctcattgtctaaatgaggcctaaatgtgtgaagtgcgatttctgcttttgtgtaccccaccaccccattaccacagctgcctttgtgtgtttgtgtcaataaaaagccaaaccctgggtcctgcttgttgcctctgagagtggagggaaggtgagctcctggaaggctagtgctgccagcagaagatctgggctgcttcctgccccctgcctctttccatgcccaaatcacgtttcctttcatgagtgaaatgaggaagaacatcatggcatgcaggctctttttactgttctgggcagtgttttgcaatgtgtgacccctccgcactgttggtgaacatacagacctcctatatgggcacccaagcccaggccagtgtgagaaccttggcgggggggtggggaggatgagaaggggaggcccctagcctgactcagaggtgaagactgctaggccctgctgtccttggggtacgactgtcagggcctctacctccccgcccccgcgggtgggcttctggaagtggatctccaggacgtcatgcagctccgggccatccaagatatcaggaatgttgagcaccagtaccgagcggggaactggctgcgacctgatctggaaaaggagccaggagatggcaaaggctcatgggagaagggctgggggctgggggtagggcaggcagtgccccatgggggtatgaggtcgggaggcctggagaggctgatggtgggtaggtaggtcagtggggtttggggcctctgatccttcattgggcaagttcctggcaggcagacaggttacccagcccagcccctgttcttcacccctcctgcttacctcagccttctggatctccccattcacatacggagagactctcagagggacttgctgcccacccagtggcactgtgaactggccgatttggcacagacgctgagccactgtggggagcaaggaggggtgggcctttagcatcaagccctctcctctccctgcaccataatcttgcacaccctataccctctcccctgcaggaggcctgcatagccctcacctccatccctagcaaaccccagcatgacactccctggcagtagctcccgaacgtccacatcgccacctccgttcctagtcttgccaaagaagatctctagcttgtccagcagctcctcctcactcagcctgaggctggcaggaaatccagtgaccaacaccctccggccactcaactggctggacacctagggggagacagcaaggggtggtcccagacacagctccacttccccatgcccaggtgcatggcatgctttgcatgccccaggattctgtcataccatcacctggatggtggtgaccatgggcagctccaagggctggacctgcacccgcagccggcactcctccatgttgatcgtgtgctccttttgttgcagcacctgctcagccactgggtggtgggaaacagggtcagtactgggaaccctccccacctccctcctgaggctccccatgagcttacctttggggtcatcaaaggtgatcagagcagagcccgcaagcagagggcagtggatccgcaaattggaaactaaagacttaggcacttccgggtcctgctgggtgtgtcctcggaataccagggggatcttgggcactgaaaatgggacctggaagtaggggaggggagtaggagtgttcctcactcccacctaggaggaaggcatctccgattccattccattgatgctgagtgccggagataaatacatttactgaaagaaaagctggataaatgagtggatgaatgcaggtctggtccatacagggcaatttacatacaacatcttaatttgtcctgggaggtgggtagctctactttacagatgttcaagtaacataatggaggtcacacagcaaggaagtagcagagccaggaataaaaccgagaactccccagctcttttttgtgtttctttgttttaaagggagtcttgctctgtcacccagctggagtgtagtggcatgatcttggctcactgcaacctccacttcccaggttcaagcaattcggactcagcctcccaagtagctgggattacaggcatgtgccaccaaacccagctaatttttgtatttttagtagagacggggtttcaccctgttggccaggctggtctcaaactgacctcaggtgatccaccagcctcggcctcccaaagtgctgggattacaggcgtgagccactgcgcccggcctaatttttgtatttttagtagagatgggatttcactgtgttggccaggctggtctcaaactcctgacctgaggtgatcaggcccccttggcctaccaaagtgctgggtttacaggtgtgagccaccgcacccggcctcgccagctcgtttttaccaaacaacaccagatcctttagggggggttattgcgggcggatttttgaaacggagggctggtgataggctttttataggtatgcatgtatatggttctagcgtagtggattttgggaattgcggt

SEQ ID NO: 82 - DNA, 25 bp, artificial sequence
  BRCA1 forward primer
gagaggttgttgtttagcggtagtt

SEQ ID NO: 83 - DNA, 20 bp, artificial sequence
  BRCA1 reverse primer
cgcgcaatcgcaattttaat

SEQ ID NO: 84 - DNA, 22 bp, artificial sequence
  BRCA1 probe oligo (6FAM--BHQ-1 format)
ccgcgcttttccgttaccacga

SEQ ID NO: 85 - DNA, 7637 bp, Homo sapiens
gatcaattaagggcatcttagaagttaggcgttcccgctgcctcctttgagcacggaggccaccaacccctagggggaagagatgtagcgcgaggcaggggtgtcgtgctaagaaatttcgacgcttctggggactgaggacaaaggtgcggacacgaccccggggtacctggagttccgtgactcgcgccacggacggcacacctaggggctaatttctgctctgcctcaaagaacctcaagctagagtccttgcctccgcccacagccccgggatgccgctgctgcgctcaccgcacaggcagcgcccggaccggctgcagcagatcgcgcgctgcgcgttccaccgggagatggtggagacgctgaaaagcttctttcttgccactctggacgctgtgggcggcaagcgccttagtccctacctctgctgagctgaacgctcaggcacagtggaactgaaacccggttctgcgggatgtgagagctgttgaggtcacgcgtaattgggtgtgatggagggcgcctgttcgtgatgtgtgcaggtttgatgcaagcaggtcatcgtcgtgcgagtgtgtggatgcgaccgcccgagagactcggaggcaggcttgggacacgtttgagtgaacacctcaggatactcttctggccagtatctgttttttagtgtctgtgattcagagtgggcacatgttgggagacagtaatgggtttgggtgtgtgtaaatgagtgtgaccggaagcgagtgtgagcttgatctaggcagggaccacacagcactgtcacacctgcctgctctttagtagaggactgaagtgcgggggtgggggtacggggccggaatagaatgtctctgggacatcttggcaaacagcagccggaagcaaaggggcagctgtgcaaacggctcaggcaggtgatggatggcagggtaggaagggggaggtccagaggtctggatggaggcttccgcatctgtaccttgcaactcacccctcaggcccagcaggtcatcggccccctcctcacacatgtaatggatctgaagagtaccccgggacagtccggggagatggagattcggaaagtatccatggagatcttacagaatcccctatgcggaccaggaaactcttgtagatccctgcctatctgaggcccaggcgctgggctgtttctcacaatattccttcaagatgagattgtggtccccatttcaaagatgagtacactgagcctctgtgaagttacttgcccatgatcacacaaccaggaattgggccaactgtaattgaactcctgtctaacaaagttcttgctcccagctccgtctcttgtttcccacgagccctggccctctgtgggtaataccagctactggagtcagatttcttgggcccagaacccacccttaggggcattaacctttaaaatctcacttggcagggtctggatcagagttggaagagtccctacaatcctggaccctttccgccaaatcgtgaaaccaggggtggagtggggcgagggttcaaaaccaggccggactgagaggtgaaattcaccatgacgtcaaactgccctcaaattcccgctcactttaagggcgttacttgttggtgcccccaccatcccccaccatttccatcaatgacctcaatgcaaatacaagtgggacggtcctgctggatcctccaggttctggaagcatgagggtgacgcaacccaggggcaaaggacccctccgcccattggttgctgtgcactggcggaactttcccgacccacagcggcgggaataagagcagtcgctggcgctgggaggcatcagagacactgcccagcccaagtgtcgccgccgcttccacagggctctggctggacgccgccgccgccgctgccaccgcctctgatccaagccacctcccgccaggtgagccccgagattctggctcaggtatatgtctctccctccctctccctccattcgtcattttctcactccctttcctcctctccctctctctccgttagtctcttcatcagatagtctctgttagtccgcgatttataccagctcgtgccctaggttggatcggacagtctcaatcccccggctcgctcttcctgctcggctgcggactccagtcttactctctcgcactgcacacaggcttaggccagtctcgggacactcaggctccccagggaccgcgcacagagcctgaggcaagagaaactttccgcagacggtgcgatcagggacggcgtctggagcccagcagtcccagggaaattggttcagaacctggaacagagcggatgggtggcaaataggcacgacgactgagggacaagcagccctaaactgcaagccccagtcacaggctctgggagcaaagagagaaagtcttgggtcccaatttaagagtaaaacttggttcctgcaggggactgaggtgccagcaggcggagcttaggctgagcactaaaattgattcttttatttctcagattccaattgcagagataatctctgtggatagatcccacccctcccaccaaggtgtatgcaaaagccccagaagaggaggacagctctgggtttccttatgggatcagcttctgtgacaggggcctgggagcatgtcctccacagagacctggctaacaggtttatatgtatctgtgtggctttggggagaagggtaggactgagacctcccccactcagctctccctctaggatcgctcctccagctctatcagactgtgcatgctacaggcccactgaacctcccagaagtccactgtgctgatgaggaaacaaaaaagaagagaaatataatgaccagtctgaagccacaaagccagagcgttagaagcaagacagaaaaccaggataggagccaaggtctgtgggctcctagaacttcgaactggcgcaggtggtttatctcattcttcccttgcagagaggtgtcatgggcttccaaaagttctcccccttcctggctctcagcatcttggtcctgttgcaggcaggcagcctccatgcagcaccattcaggtaagacagcctgaagccagaaggacactggtatcagacaattccatgcctcttaagtgtggtgtactgaatgcttaaaaaccgacagggggccggggtaaggtatgtactcatgcacatatataattttttgatataaaaatgtgtggtacacaatttataagtagtgataaatatttagacaatattcttcattataatttttttgagacagagtctcactctgtcatccatgctggagtgcaatggcaccgtgtcggctcactgcaacttccatctcctgggttcaagcaattctcctgcctcagcctcccaagtagccgggattacaggcgcccaccaccatgcccggctaatttttgtatttttagtagagatagggtttcaccatgttggccaggctggtctcaaactcctgacctcaggtgatccacctgcctcagcctcccaaagtgctgagattacagccgtgagccaccgcgcccggcctattataaattttatatagcccactgagtctcacaaaatgcttttgttgcttttagccaaacttttgtatgtgtagccatcctatttatcctattcagccatgatttgaaaaatgaattgcatcctattctgttaaatagtttgccactaaatttgttattgttaaatctggtattttacctgttgatctattctcacccacatataaatctattaaactgaaactattttcaggttcagcactaactgtaagtttttgcatttaatttttaataatggctgcactcagcttgcaaaattcttgaaaatttaaccattagctttcacaagcctatacaaactggctccagcacaccactgtttagaggccacaccagtgcctgggtcctgaggaggacactggccttgtgccctgtcccctaggactcccgctggccacatcctcaggggaagaagcaaagaccaggaagcctggctgcttatcctggggaggggcaggcaggggctcacagcctgcactgagtttgcttcccctccacaggtctgccctggagagcagcccagcagacccggccacgctcagtgaggacgaagcgcgcctcctgctggctgcactggtgcaggactatgtgcagatgaaggccagtgagctggagcaggagcaagagagagagggctccaggtgaggctccccaagcgctcagcacagggcctcctctccccgcagcatacacaggaaggtggatcccgagaggtaggagagaacacactggccaggaatccaacaggctgtgttgttcaccgggacctggggcccagctgttctcagcctccaagggagacagaggtcccactgcagctggaggtaccgtggttagacataacaaaaggctccgtttctgaaagttcttaggaaatgaaatggggaggtgtggaatcgctcactgtgggaattgttcttgcagtactgggagacctcccagcactggatgagttaagactagtaagggtgaagtcagggatacacatagtacatctcaggaagttttagaaagtttggatccaccttgttaatctgcatacgacattctttcacacctgcaaggagactttcatttcacatttgcaaggtgaaggtgaggcccttgcaggggatggggatgggtagagcagtgtctgaggtaggtttgagcctttaaatgtgtggcatctgtggagatgtgcatgttgtcaggaggccagggagagcacccttccccagatccacatccctgtgtaccttgagcctgagcagagaccagcccctggcctggccccagcactgctcaggcagaggcatgtgttgcccctgcatctgccctgagaacccctctgtcaagcatgaaggactgaacagcatgtggaatgccagaaaagatcatccttccccatccagcccttccctgcattgccctagcccactgcacctctgagctctcctaatgaaggatagataagtgagctgccctcctgcctgcccctcctgctcccagggtcccctgcctggtctaaccttctaagtgactgcccatggggacagattctggtgcatggtactgtctggtatgtgttttccctgcagcctggacagccccagatctaagcggtgtggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttctagcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaagatctgagctgtggtggtcattgctctgatctatgtcccaggcttcatagtgtctaagacctatgcttagaaatagccttaaccctaggctagctggacagaggatatggtgggtggtccctttgaccaagctcaagcaggaagaacaggggtcctaaggagcaggtaagcacctctaggacttgatgctgcaaactccgctcctcttccaggtaagactgaggaattttttattttcctaagaaagggtatttggtgcccgtgactggggtgtagattttatagtcctttgtgaatggggctgggtgtgggaccataattcactccagtgtcataaacctccgctttgatttttagttaatttatacaggaaagattggctgttactgctccacattccatagccagtcatccagagtcaccttgggttttctgacacccctgggaatatctatggggagtgatcatggcattttccctaatggccttgtgattttctgctctgataattgtgtttaggagaaacacttaaagttaattggtgcctttcagcacagcaactttaccatgaaggtccatggggctgacctctctcccagcctctcactcacagatcttctcttctttctccatcctgcaaatcagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtgactgcccttgtatgatgggatgggaagatgaatgactggtttttactggggtgtaaaaccactctgagcctctctgagaccatgtggttttaaaaaatccataagggaaggtacccacaccagtatctgagttccagtagctaagaccctagaatttggattcatctctgttttttcatgtctctccttgtaaccctgagatcatcagaccaagaaatacagatcctgtttatttagaacactgctgtttgacatttattaattttgattattctagcctttgagtttgaaagataatgacactatcattttagagtatacattactatgttgtgtacctctgaattaagtgtacagacttgagttcaagaactgtatttgccctttaccagctatatgaccatgaacaggttacttaactctctccaagcctcagtttctccatctgtaaattgagggctacaatagtacctacctccaagcattactataaagagcaagtgaggtaatagatgttaagtctgacaattaaccagtaactaaattctagctgttattttcttcctcctaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaatggaatctctgctgctatttatgctatttttcccaggagagttcaggggcctgtaagcactctgttgaccaaccaatctgactcacttagcacaatgacaacatgcctgggtaggatcc

SEQ ID NO: 86 - DNA, 23 bp, artificial sequence
  CALCA forward primer
gttttggaagtatgagggtgacg

SEQ ID NO: 87 - DNA, 19 bp, artificial sequence
  CALCA reverse primer
ttcccgccgctataaatcg

SEQ ID NO: 88 - DNA, 30 bp, artificial sequence
  CALCA probe oligo (6FAM--TAMRA format)
attccgccaatacacaacaaccaataaacg

SEQ ID NO: 89 - DNA, 1630 bp, Homo sapiens
gagctcgagccacgccatgcccgctgcacgtgccagcttgcgcagcacatcagggcgctggtctctccccttcctcctggagtgaaatacaccaaagggcgcggtgggggtggggggtgacgggaggaaggaggtgaagaaacgccaccagatcgtatctcctgtaaagacagccttgactcaaggatgcgttagagcacgtgtcagggccgaccgtgctggcggacttcaccgcagtcggctcccagggagaaagcctggcagagtgaggcgcgaaaccggagggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctgggcgggggaaccgctgggagccctgcccccggcctgcggcggccctagacgctgcaccgcgtcgccccacgggccccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctattttctaaaatcaccccctcccttatttttcacttaagggacctatttctaaattgtctgaggtcaccccatcttcagataatctaccctacattcctggatcttaaatacaagggcaggaggattaggatccgttttgaagaagccaaagttggagggtcgtattttggcgtgctacacctacagaatgagtgaaattagagggcagaaataggagtcggtagttttttgtgggttgcctgtccggggcccctggcatgcaggctggatggagggagaggggtggggggtggcgggggaccgcgtttgaagttgggtcgggccagctgctgttctccttaataacgagaggggaaaaggagggagggagggagagattgaaaggaggaggggaggaccgggaggggaggaaaggggaggaggaaccagagcggggaggcgcggggagagggaggagagctaactgcccagccagcttgcgtcaccgcttcagagcggagaagagcgagcaggggagagcgagaccagttttaaggggaggaccggtgcgagtgaggcagccccgaggctctgctcgcccaccacccaatcctcgcctcccttctgctccaccttctctctctgccctcacctctcccccgaaaaccccctatttagccaaaggaaggaggtcaggggaacgctctcccctccccttccaaaaaacaaaaacagaaaaacccttttccaggccggggaaagcaggagggagaggggccgccgggctggccatggag

SEQ ID NO: 90 - DNA, 17 bp, artificial sequence
  CCND2 forward primer
ggagggtcggcgaggat

SEQ ID NO: 91 - DNA, 22 bp, artificial sequence
  CCND2 reverse primer
tcctttccccgaaaacataaaa

SEQ ID NO: 92 - DNA, 20 bp, artificial sequence
  CCND2 probe oligo (6FAM--BHQ-1 format)
cacgctcgatccttcgcccg

SEQ ID NO: 93 - DNA, 1193 bp, Homo sapiens
tctagaaaaattttttaaaaaattaggccgctcgagcgagagtgcagtggctcacgcctgtaatccaacacttcaggaggctgaagagggtggatcacctgaggtcaggagttccagaccagcctggccaacatggtgaaaccccgtcttgtactaaaaatacaaaattagccggtgtggtggcacacgcctgtagtcccagctactcaataggctgagacaggagagtctcttgaacccggcaggcggaggttgcagtgagccgagatcgtgccactgcactccagcctgggcaagacagagcgagactccgtctcaaaaaatacaaacaaaacaaacaaacaaaaaattaggctgctagctcagtggctcatggctcacacctgaaatcctagcactttgggaggccaaggcaggaggatcgcttcagcccaggagttcgagaccaggctgggcaatacagggagacacagcgcccccactgcccctgtccgccccgacttgtctctctacaaaaaggcaaaagaaaaaaaaaattagcctggcgtggtggtgtgcacctgtactcccagctactagagaggctggggccagaggaccgcttgagcccaggagttcgaggctgcagtgagctgtgatcgcaccactgcactccagcttgggtgaaagagtgagccccatctccaaaacgaacaaacaaaaaatcccaaaaaacaaaagaactcagccaagtgtaaaagccctttctgatcccaggtcttagtgagccaccggcggggctgggattcgaacccagtggaatcagaaccgtgcaggtcccataacccacctagaccctagcaactccaggctagagggtcaccgcgtctatgcgaggccgggtgggcgggccgtcagctccgccctggggaggggtccgcgctgctgattggctgtggccggcaggtgaaccctcagccaatcagcggtacggggggcggtgctccggggctcacctggctgcagccacgcaccccctctcagtggcgtcggaactgcaaagcacctgtgagcttgcggaagtcagttcagactccagcccgctccagcccggcccgacccgaccgcacccggcgcctgccctcgctcggcgtccccggccagccatgggcccttggagccgcagcctctcggcgctgctgctgctgctgcag

SEQ ID NO: 94 - DNA, 26 bp, artificial sequence
  CDH1 forward primer
aattttaggttagagggttatcgcgt

SEQ ID NO: 95 - DNA, 22 bp, artificial sequence
  CDH1 reverse primer
tccccaaaacgaaactaacgac

SEQ ID NO: 96 - DNA, 19 bp, artificial sequence
  CDH1 probe oligo (6FAM--TAMRA format)
cgcccacccgacctcgcat

SEQ ID NO: 97 - DNA, 1163 bp, Homo sapiens
ctcctccgagcactcgctcacggcgtccccttgcctggaaagataccgcggtccctccagaggatttgagggacagggtcggagggggctcttccgccagcaccggaggaagaaagaggaggggctggctggtcaccagagggtggggcggaccgcgtgcgctcggcggctgcggagagggggagagcaggcagcgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatatatgccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactcaaaa

SEQ ID NO: 98 - DNA, 22 bp, artificial sequence
  CDKN2A forward primer
tggagttttcggttgattggtt

SEQ ID NO: 99 - DNA, 19 bp, artificial sequence
  CDKN2A reverse primer
aacaacgcccgcacctcct

SEQ ID NO: 100 - DNA, 18 bp, artificial sequence
  CDKN2A probe oligo (6FAM--TAMRA format)
acccgaccccgaaccgcg

SEQ ID NO: 101 - DNA, 5910 bp, Homo sapiens
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcaagttacttgtgcagcttcggctcaaatcccaatatccaggacaaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaacccagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgtggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccaataacggggctcccaaggatttcctccccagccccctccacgccctgctgcgggaatggaccacctaccctgagagcacagtgggcaccctcatgtccaaactgagggagctgggtcgccgggatgccgcagaccttttgctgaaggcatcctctgtgttcaaaatcaacctggatggcaatggccaggaggcctatgcctcgagctgcaacagcggcacctcttacaattccattagctctgttgtatcccggtgagggcagcctctggcttggacagggtctgtttggactgcagaaccaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactatcatattgattgtcctttaaaaaagaaaagtgcatatttatccaaaatgtgtatttcttatacgcttttctgtgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttaaaaaaaaaaaaaa

SEQ ID NO: 102 - DNA, 21 bp, artificial sequence
  DAPK1 forward primer
tcgtcgtcgtttcggttagtt

SEQ ID NO: 103 - DNA, 19 bp, artificial sequence
  DAPK1 reverse primer
tccctccgaaacgctatcg

SEQ ID NO: 104 - DNA, 21 bp, artificial sequence
  DAPK1 probe oligo (6FAM--BHQ-1 format)
cgaccataaacgccaacgccg

SEQ ID NO: 105 - DNA, 6453 bp, Homo sapiens
ggatcccagcctttccccagcccgtagccccgggacctccgcggtgggcggcgccgcgctgccggcgcagggagggcctctggtgcaccggcaccgctgagtcgggttctctcgccggcctgttcccgggagagcccggggccctgctcggagatgccgccccgggcccccagacaccggctccctggccttcctcgagcaaccccgagctcggctccggtctccagccaagcccaaccccgagaggccgcggccctactggctccgcctcccgcgttgctcccggaagccccgcccgaccgcggctcctgacagacgggccgctcagccaaccggggtggggcggggcccgatggcgcgcagccaatggtaggccgcgcctggcagacggacgggcgcggggcggggcgtgcgcaggcccgcccgagtctccgccgcccgtgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtgagtgcgggcagggatcggccgggccgcgcgccctcctcgcccccaggcggcagcaatacgcgcggcgcgggccgggggcgcggggccggcgggcgtaagcggcggcggcggcggcgggtgggtggggccgggcggggcccgcgggcacaggtgagcgggcgtcgggggctgcggcgggcgggggccccttcctccctggggcctgcgggaatccgggccccacccgtggcctcgcgctgggcacggtccccacgccggcgtacccgggagcctcgggcccggcgccctcacacccgggggcgtctgggaggaggcggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtaggcacgctgcagtccttgctgcctggcgttggggcccagggaccgctgtgggtttgcccttcagatggccctgccagcagctgccctgtggggcctggggctgggcctgggcctggctgagcagggccctccttggcaggtggggcaggagaccctgtaggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggtgagcctagcgccgccgtccaggtgccagcagctgctgcgggcgagcccaggacacagccaggatagggctggctgcagcccctggtcccctgcatggtgctgtggccctgtctcctgcttcctctagaggaggggagtccctcgtctcagcaccccaggagaggagggggcatgaggggcatgagaggtaccagggagaggctggctgtgtgaactccccccacggaaggtcctgagggggtccctgagccctgtcctcctgcaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacaggtgaaccccgtgaggctggcccgggagcccacgccgcacaggtggggccaggccggctgcgtccaggcaggggcctcctgtcctctctgcgcatgtcctggatgccgctgcgcctgcagcccccgtagccagctctcgctttccacctctcagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcaggtgaggcagctctccaccccacagctagccagggacccgccccgccccgccccagccagggagcagcactcactgaccctctcccttgacacagggcagccgctctggctctagctccagctccgggaccctctgggaccccccgggacccatgtgacccagcggcccctcgcactgtaggtctcccgggacggcagggcagtgagggaggcgagggccggggtctgggctcacgccctgcagtcctgggccgacacagctccggggaaggcggaggtccttggggagagctgccctgagccaggccggagcggtgaccctggggcccggcccctcttgtccccagagtgtcccacgggcacctgttggttctgagtcttagtggggctactggggacacgggccgtagctgagtcgagagctgggtgcagggtggtcaaaccctggccagacctggagttcaggagggccccgggccaccctgacctttgaggggctgctgtagcatgatgcgggtggccctgggcacttcgagatggccagagtccagcttcccgtgtgtgtggtgggcctggggaagtggctggtggagtcgggagcttcgggccaggcaaggcttgatcccacagcagggagcccctcacccaggcaggcggccacaggccggtccctcctgatcccatccctcctttcccagggagtggaggatgccttctacacgttggtgcgtgagatccggcagcacaagctgcggaagctgaaccctcctgatgagagtggccccggctgcatgagctgcaagtgtgtgctctcctgacgcaggtgagggggactcccagggcggccgccacgcccaccggatgaccccggctccccgcccctgccggtctcctggcctgcggtcagcagcctcccttgtgccccgcccagcacaagctcaggacatggaggtgccggatgcaggaaggaggtgcagacggaaggaggaggaaggaaggacggaagcaaggaaggaaggaagggctgctggagcccagtcaccccgggaccgtgggccgaggtgactgcagaccctcccagggaggctgtgcacagactgtcttgaacatcccaaatgccaccggaaccccagcccttagctcccctcccaggcctctgtgggcccttgtcgggcacagatgggatcacagtaaattattggatggtcttgatcttggttttcggctgagggtgggacacggtgcgcgtgtggcctggcatgaggtatgtcggaacctcaggcctgtccagccctgggctctccatagcctttgggagggggaggttgggagaggccggtcaggggtctgggctgtggtgctctctcctcccgcctgccccagtgtccacggcttctggcagagagctctggacaagcaggcagatcataaggacagagagcttactgtgcttctaccaactaggagggcgtcctggtcctccagagggaggtggtttcaggggttggggatctgtgccggtggctctggtctctgctgggagccttcttggcggtgagaggcatcacctttcctgacttgctcccagcgtgaaatgcacctgccaagaatggcagacatagggaccccgcctcctgggccttcacatgcccagttttcttcggctctgtggcctgaagcggtctgtggaccttggaagtagggctccagcaccgactggcctcaggcctctgcctcattggtggtcgggtagcggccagtagggcgtgggagcctggccatccctgcctcctggagtggacgaggttggcagctggtccgtctgctcctgccccactctcccccgcccctgccctcaccctacccttgccccacgcctgcctcatggctggttgctcttggagcctggtagtgtcactggctcagccttgctgggtatacacaggctctgccacccactctgctccaaggggcttgccctgccttgggccaagttctaggtctggccacagccacagacagctcagtcccctgtgtggtcatcctggcttctgctgggggcccacagcgcccctggtgcccctcccctcccagggcccgggttgaggctgggccaggccctctgggacggggacttgtgccctgtcagggttccctatccctgaggttgggggagagctagcagggcatgccgctggctggccagggctgcagggacactcccccttttgtccagggaataccacactcgcccttctctccagcgaacaccacactcgcccttctctccaggggacgccacactcccccttctgtccaggggacgccacactcccccttctctccaggggacgccacactcgcccttctctccaggggacgccacactcgcccttctctccaggggacgccacactcgcccttctgtccaggggacgccacactcgcccttctctccaggggacgccacactcgcccttctctccaggggacgccacactcccccttctgtccaggggacgccacactcccccttctctccaggggacgccacactcccccttctctccaggggacgccacactcgcccttctctccaggggacgccacactcccccttctgtccaggggacgccacactcgcccttctctccaggggacgccacactcgcccttctctccaggggacgccacactcccccttctctccaggggacgccacactcccccttctctccaggggacgccacactcccccttctgtccaggggacgccacactcgcccttctctccaggggacgccacactcccccttctctccaggggacgccacactcccccttctctccaggggacgccacactcccccttctgtccaggggacgccacactcgcccttctctccaggggacgccacactcgcccttctctccaggggacgccacactcgcccttctctccaggggacgccacacttgcccttctgtccagggaatgccacactcccccttctccccagcagcctccgagtgaccagcttccccatcgatagacttcccgaggccaggagccctctagggctgccgggtgccaccctggctccttccacaccgtgctggtcactgcctgctgggggcgtcagatgcaggtgaccctgtgcaggaggtatctctggacctgcctcttggtcattacggggctgggcagggcctggtatcagggccccgctggggttgcagggctgggcctgtgctgtggtcctggggtgtccaggacagacgtggaggggtcagggcccagcacccctgctccatgctgaactgtgggaagcatccaggtccctgggtggcttcaacaggagttccagcacgggaaccactggacaacctggggtgtgtcctgatctggggacaggccagccacaccccgagtcctagggactccagagagcagcccactgccctgggctccacggaagccccctcatgccgctaggccttggcctcggggacagcccagctaggccagtgtgtggcaggaccaggcccccatgtgggagctgaccccttgggattctggagctgtgctgatgggcaggggagagccagctcctccccttgagggagggtcttgatgcctggggttacccgcagaggcctgggtgccgggacgctccccggtttggctgaaaggaaagcagatgtggtcagcttctccactgagcccatctggtcttcccggggctgggccccatagatctgggtccctgtgtggcccccctggtctgatgccgaggatacccctgcaaactgccaatcccagaggacaagactgggaagtccctgcagggagagcccatccccgcaccctgacccacaagagggactcctgctgcccaccaggcatccctccagggatcc

SEQ ID NO: 106 - DNA, 24 bp, artificial sequence
  HRAS1 forward primer
gagcgatgacggaatataagttgg

SEQ ID NO: 107 - DNA, 29 bp, artificial sequence
  HRAS1 reverse primer
cgtccacaaaataattctaaatcaactaa

SEQ ID NO: 108 - DNA, 23 bp, artificial sequence
  HRAS1 probe oligo (6FAM--BHQ-1 format)
cactcttacccacaccgccgacg

SEQ ID NO: 109 - DNA, 1074 bp, Homo sapiens
ggtcaggaaagctcaggcaagcccaccctcaggcattacagctagactccgagcttactgggcagtcatctgattcgaccaacatcagttcgcagggcttaagcccagtcccttacggcggctggggagggaccaggcccaagtatataaagctccctgagggtccgcgttggctttgcgcctgtgagtgtgattcaagaacgtcccagtgcccttggctcctttcggagtgtgaccccgtgcttgcacgggacacgttacccagctcgggtgagaagggtatcttccgggaacctcgcctttaatagcacaacgagcgcagagtccactggatctgcgagaagaaaccgcgctaactagtttgtccctacggccgcctcgtagtcactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagggactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgattttgaatcacccagataaaggtggatctccttacgtagcagccaaaataaatgaagcaaaagacttgctagaaacaaccaccaaacattgatgcttaaggaccacactgaaggaaaaaaaaagaggggacttcgaaaaaaaaaaaagccctgcaaaatattctaaaacatggtcttcttaattttctatatggattgaccacagtcttatcttccaccattaagctgtataacaataaaatgttaatagtcttgctttttattatcttttaaagatctccttaaattct

SEQ ID NO: 110 - DNA, 21 bp, artificial sequence
  MCJ forward primer
tttcgggtcgttttgttatgg

SEQ ID NO: 111 - DNA, 28 bp, artificial sequence
  MCJ reverse primer
actacaaatactcaacgtaacgcaaact

SEQ ID NO: 112 - DNA, 30 bp, artificial sequence
  MCJ probe oligo (6FAM--BHQ-1 format)
tcgccaactaaaacgataacaccacgaaca

SEQ ID NO: 113 - DNA, 1157 bp, Homo sapiens
ggatcctgctccctctgaaggctccagggaagagtgtcctctgctccctccgaaggctccagggaagggtctgtcctcttaggcttctggtggcttgcaggtgcagccctccaatcctcctccccaagcggcctgctgcctataaggacacgagtcatactggatgaggggcccactaattgatggcttctgtaaagtccccatctccaaataaggtcacattgtgaggtactgggagttaggactccaacatagcttctctggtggacacaattcaactcctaataacgtccacacaaccccaagcagggcctggcaccctgtgtgctctctggagagcggctgagtcaggctctggcagtgtctaggccatcggtgactgcagcccctggacggcatcgcccaccacaggccctggaggctgcccccacggccccctgacagggtctctgctggtctgggggtccctgactaggggagcggccccaggaggggagagactcgcgctccgggctcagcgtagccgccccgagcaggaccgggattctcactaagcgggcgccgtcctacgacccccgcgcgctttcaggaccactcgggcacgtggcaggtcgcttgcacgcccgcggactatccctgtgacaggaaaaggtacgggccatttggcaaactaaggcacagagcctcaggcggaagctgggaaggcgccgcccggcttgtaccggccgaagggccatccgggtcaggcgcacagggcagcggcgctgccggaggaccagggccggcgtgccggcgtccagcgaggatgcgcagactgcctcaggcccggcgccgccgcactgggcatgcgccgacccggtcgggcgggaacaccccgccccgcccgggctccgccccagctccgcccccgcgcgccccggccccgcccccgcgcgctctcttgcttttctcaggtcctcggctccgccccgctctagaccccgccccacgccgccatccccgtgcccctcggccccgcccccgcgccccggatatgctgggacagcccgcgcccctagaacgctttgcgtcccgacgcccgcaggtcctcgcggtgcgcaccgtttgcgacttggtgagtgtctgggtcgcctcgctcccggaagagtgcggagctc

SEQ ID NO: 114 - DNA, 20 bp, artificial sequence
  MGMT forward primer
gcgtttcgacgttcgtaggt

SEQ ID NO: 115 - DNA, 21 bp, artificial sequence
  MGMT reverse primer
cactcttccgaaaacgaaacg

SEQ ID NO: 116 - DNA, 21 bp, artificial sequence
  MGMT probe oligo (6FAM--TAMRA format)
cgcaaacgatacgcaccgcga

SEQ ID NO: 117 - DNA, 12825 bp, Homo sapiens
  misc_feature (3788)..(3788): n is a, c, g, or t
ggatccagcgtcagccacctgaggaacatcccaacacatgtcatgcctccgggccttcacccatgctgttctgtaagcccggaaagcctttctctacagcagccccccgacccactttgggcactcctattcatccttcagtaaccaagaagaaggatagcaatatttcctccttggggaactcttcttgggtgtccacaagagagttcattgttccctcttggtgctcccccagggtgttttgattattcatttatggattgctctttccccaacagacagagctctttgaggctggggatgctgtctgaatcatccctagatcttactgcacctaacctggggcctggaaacagggtgggtgtctggggaatgcttgaggggttgggggaggttaggcctgttgaggcgcatgggccataaatcaccttcccaagccagggggaaagcagcaatccaggagagcttcacggaggtggcaggacgggatgtaggacggaggcaaaccatagactcgcaggcggtgagggcatcattcatgagacctctgccctccgttcttctgccaggaaacccctgtcctgggtgctattggccagggataagcagattttggaggggggaatcaggcttcttcaaggcgttaggtctccactcagaggtatgtggctggggcagctgctgggggctgcagctggtgtctgtcccagagcccaacggctgtgtgtgccttaatcccagtccttggtgccccccaggctggcaggtggactgatgaggcagaaaggaggcaacaggagaggggtggagagccgagccccctctccaggtccccacagccgccctctggatcttgctacatgtgccaccccatcaccaggtcctcgtcaccagctatcccctcagccctgagctgctcctccctcagcccttagagggaggtctgacctccttgaggtaggaagattcagcttaaaaagttcaaactggaaaacacaaagaagagatggatgtcacggcatctgtgccccttagcgtcttctttctgaatggggctggggatgtttaggcacataggtggagacaagcattcacactgggactgaggtgtggacgtacctaacttagaatatgagcaggtgggacgcatctgtggtgtgcacatggcatgtgaagtgtgtgtgttctgtaggtgaggggtgcacagcatgggaggtatacgcatgtgtgaggtgtgcatggactatgaagcatgcacagtatatgaggtgtaatatgtgtgatatgcacatgatgtgagagaggaaatatcccatatgtgggacatactgctgttggaggtttacatggcatgtgagtttacatagagtgtcaagtgtatccggagtgttaggtgtacatggcatgtaatgtgtaaacaatgtgagacttgtacatagtatgtgaggtaacatggagtgtgaggtgtgtgtgtgtgtgaggtgtacatggagtgggatatgtacacaatataagagatgtacccagtgtgtaacatattcatggagtgtgaggtagacatggcacaagagagatacacacagtgcttgagatatatgtggtatgtgaggtgtacagagagggtgaactgtacattatgtgagaggtgtgcagtatgtgagaggtgtacagtatgtgaaaggtgtgcagtatgtgaaagatgcacattatgagagaggtagatggagcataaggtgtacattatgtgacaggcatagagggaacgtgagctgtacattctgtgagaggcacataggaattgtgaggtgtacactatgtgagaggtatacattatgtgaaagatgtacattatgagagaagctgcaggcagcatgtggtgtacatcctgtgagaggcgtgcagggagtgtgaggcgtgcgttctgtgagaggcatgcagggagtgtgaggtgtgtattctgtgagaggcgtgcagggggtgtgcggcgtgcattctgtgagaggcatgcagggagtgtgcagcatgcattctgtgagaagcgtgcagggagtgtgaggcgtgcattctgtgagaggcgtgcagggaatgtgaggcgtgcattctgtgagaggcgtgcagggagtgtgaggcgtgtattctgtgagaggcttgcagggaatgtgaggcgtgtattctgtgagaggcgtgcagggagtgtgaggtgtgcattctgtgagaggcgtgcagggaatgtgaggcgtgtattctgtgagaggtgtgcagggagtgtgaggcgtgcattctgtgagaggcgtgcagggaatgtgaggcgtgtattctgtgagaggtgtgcagggagtgtgaggcatgcattctgtgagaggcatgcagggagtatgtggcatgcattctgtgagaggcgtgcagggggtgtgtggtgtgcattctgtgagaggtgtgcagggagtgtgaggtgtacattatcagagaggtgtacagggagcgtgcactgtatattgtgtgagaggtgtgcacagtgtaaggtgagcactgtatgtgacttgtctgcagtttatcaggtgcacatagctatgacaccacaaaggcatatggaagaatgcaggtgaggacaaactgtccttccaagaaaatgtgcttgtcagctctgtcctgggctcacactctggacgcatggcacaacctcctgagcagtgtcacaggcagaggagacagagggacgtcctctggcttttcaggagtccttttatacataaaggagaaggcagctttgagaggccttctcctccatccttctgcctgcatccataccacgttagctcaagggcaatgtgctctttgaggaataccatacgttggtaatattatttttacatctgacttaaatccctcatgctgcaagttgaattcgcatttttttggtgctttcaaatgtgaaggtagtgaactctcctttcatgtagacctcctcaccccgggagcctaatgtctttaggctagaagaataattagcaccttcatgagctctgcctgcttgaacacttctagtcattaagttattgtcaccttatttgtgttgtttagtaaacagcgcatgtgtatttcaaaccccaggaatctagtcccacaaagaccccagggctcacctctgaggcagagaaagtctttaattacataaagaataagcttgaagaagagaggctggatgaatgaatgaacgcctcaggtctttccagaagccaggcatcagtgggttcttaagcctggcctcagcttcccctacctggtgggcagtctcagctcctgctattttcactcatctggcttcctagtgtctgggaaagaacccggagtgagaggcattgtgagggctgcatggaatgtgaggtgcacatggcatgtggggcctcgtgggggaaagagctgggcgggctgcagggagggtccccccataacaccaagctcacatgggtcacatcccatgccctttagcctcttcccctgggtagcagcccaccctcatctcacatcctgaattgggctaaagcttagttctagatgaagttataattaaatttaaaatcacatctagagaattccctcttaaatttaagtactatgtcagttttggagggagtttttataaacctattgaagaggggaataaacagctctagcctattatgcctagttcttcaagaatctcttggtttgtaagatattctttcattagaagtaacaaattggccaggtgcgggtggctcatgcctgtaatcccagcactttgggangctgaggcaggtagatcacctgaggtcaggaattcgagaacagcctggccaacatggtgaaaccccatctctactaaaaacacacaaaaaatagccagacatggtggctcgcgcctgttgtcccagctactcaggaggctgaggcacgagaatcgcttgaaccccggcagcaaaggttgcagtgagctgagatcgcgccactgcactccagcctgggcgacagagcgagattctgtttcaattttttaaaaaagaagaagaagtaacagattgcccatcaaaccccatgcccaaactctatctcgtgccacccccacaccccccagcccctacagctccaggagccatgcctgtctgtacccacagaaatcctctgctcctagcagaagcgattgtcccatagaaggtgctcaataattattttgttctctctgccgggagcattcttccccagatgccacatggctaactcccaagcctcttttaactctttgctcaaatgttaccttgccaacctgaccactctgtttaacactacagccgaccccaacctggcacctcaatcctgctcatcttgttctgcttgtaatatttttctgcgtgtatcgccttctaacatctatataatttatttattattatgtgtattgcttattgtctgccctgccctgcccgcatgtcagttccacaggaacaaggaacatggtctgtttcattctccatcacattcccagcacctgaataaatgtttgttgtataagtgaatgaatcatagactggacaactgagagtgggaatatccccaccaccccaatagtgccctgcccccaccccctgcacactgggtgggaagggcacatgctgttggttgtcttcctgttccctccctccacagtgtggactcctgttcttcaactcccagctcagctgccagactcctaagccctgcttgtctgtgggaggctggagagtacccccaaagggggaaatgtggccttctgtgaggaatctctgggaccctgtccctaatctgggaccatgtctatatcctggcaatatcacagtccctcctgaccaacccagactgggcccagagaaggatctatacccatgtggtgggtggattttggctttcccagggagcaagtttgtcaggggacagagggaggcactcaggttggacccaggaacaggaagggaaaggctggggacagagaggggacctggagctggccctgccccaccaggcccactcatgcttttaccttctggccctttggcgccccccacttcccggccagatacgcagcctgtgtcagccccagtgcagagccacaggcccagcttgggcaggggcagggtgcgtgaagactggggcaggtgcaggctggattgggtttccagaggctatatatataaaggctgccgggagccccagggccgctccctgagggcacaacactgtgggggcccagccaggcccgcattcctttccagaggccagctttccatttatagcccctgggcagagcagccaagggagctgagaggggaggactggaaagggcagagggagaaggggcagcccaggcagcactccctccccactccccaccaaatgagcccctcatcatgaagacagcagaagccaggcccagggcgaggtgtgcacatgcccccaagcacagagcctaccattctggtcagacctgcgttgaggggtgagggggctgccagggatccctcaaagtcctcagcccattgctagtggcccctcacagaacaagtccagcacctgtggacaaagggcacccttgactagactctgcagtataagagtttgaatgttttcagcttccaaacttggtatcctttttccctccgcccccaacccagcactgggactaaaaggacaacatgtcccaggttggacatacttctccctgctctgtgggcagcagggaagagatgatggtgttgacaaacctctctccaaagaggagacgcaaccagaagggtgattccaggcaggtgtggatgccaggcatggagaggtctgaaatggtcaccgagttcagtgagttccaatctttttttgagcaacggaagcctggtagcaaacaaaaatcccacttgaaagcctaatataaaaatggcattttacccctagaatgtctgtgtgctttaaaacagcgcttcctaattatgggaagaagatgtagctgcaaatcaagcttaaaactgtcaaagcagtttagatttataagccataagtgataaaatattaaatgtgtttggtaagttcaaacatataacatttacttatttattgtaaaggcaacttgatgacagccctgaggaagtttttagaaactcaaagcacaaaaagcaaagttgtattcacttgtctcagcatccaatttattttgtagtttcttgcttattcagatttggggaaaatctagatttgcatagataagtggtttgaatagctcacctgggaatctcagagtactctttaattaagtagactcattcattcatttgcccaagaaatatttattgagtgcctactatgcacctggctttctgctgagcctgagcaagtaggaagagtatttgtttctaaatcatcaatacaacaattacttacattcctcattgtgagtatagtgaaaaaacaataagaagacacatcgagatgccaaatctctctatagtataccactacaatattgcagcatgccatgtataatgcccagttcaagagaacatgccccaggcagatggggtctgagcctttcctgggaagagcaagtgtaatagaacatggatgtctaatcatgtatgtgacttcccagttttgaagaaattcaaccatcttcattaatgtcacagttcaagacgttcaaatatatgcatagagatgcaaagggcgtgaggccactcattcattcactggacatttatcaggtgcctactgtgtgactgccactgtgatggtttttggaaatgtcattgtgaacaaaacatctttgccttcatggggctaagtcagtcatgaacaaactaatgaagaagattataaagagtggcagtgcctggaaggaaattaacagggtggtgtgaaccagagtatggggggcagttatcttagagggaatggtcagtgatgtcccaaggaggcaagaagatctattatataaaatgcagtcaatcttgggaaaagcccaggggataatgctatgagtttagagcagcaaggacaaggctccaaggcaggatcctgttcagagtgttagaagacaagaaaggaggtcaggctaactggagtagagcaatcaaaacggatggtgcctccaggtgtagtaagagacacaggctgaggctagctcatgcagggcctgataggccaggggatggagatgagattttactctaaatgcaagaagctgctggggagtttgaagcaggaggatggcataatcccatttacattgtaaaggtctactcaggctgctatgtaacgaatggattatactgaggctacagaggaagtgaggagggcagccaggttattgtggtcatccagagcagcagtgtgacagcttagtccaggatggtgacactagggatggactgacttgagacaggtcttagaggtagaatggacagctcttcctcatactcagacctctccttgggaactccagccttaaaaatccccctgcctaatccacacttccatctggatatccgatatgcatttcaaatttttgcccaaacctggacacttaatctaccacccacaaacctagtcttctcaactccattcttgcaggagtcatccttagctccttgcttatctcacttcccacatgcaatcgtgagtaaatactgctagctccatcttgaaaacatatatctagaattcaaccaccacttttcaccagctccactcactggggattattgcaatagcctcctaattggtctccctccttctgccctttccctccagtaaccagcatgctcctgttaaaatgtaaatcagatagtgatattcttctcttccgctcaagccctccagtgagatggctcaagccatctcagaatataatcctgtttctctctctctcaccccatttcccactatctcttttactcaccctgctgcagacatatgagcctccttgccatactttgaatctgccaaacatggtcctgcctcaggacttttgcacatgcttatccctctatctggccctacatatctccaggtatctgcttccaattctcttcattcaggtctctgcttaaatgtagcagagaggccttctctaatcactccataatcttcatcactgtgtctccctgccttgctttttcttcataaggcttctaacctcctggcatcacatacttccttgcttatttgttcattgtctatcaccctgcttacattgacaatgtaagtgccatgtaagcagagtcttggttttgttcattgctctagccccacacttggactggtacctgccacataatggatacctaacaatatgtggatttccgggtgacccctgcagcttgggtggggtgaggcagaacttgctggctctgccaggatttagagttactgtcactgctgctccatgatgtagactttactgaatgaacaaatacaggtgggccctatggagtaaagcgaggtgagtacttcatgaagggagaccttcagcaccactaccagcagcagagaagtgaagaagttaggaccccaacagagccctctgagttttgtgggaagggaggacttcttagggcccagaacggccagctagaatgccttccagaagttagtgggaaaggcacaaagatcactcctgcttaaatttctggtttccaggaggggagatccaggcagggatgtatggccaacggagattcctagccagagtgctgagaggactgtgtgaactgcagattcaggaagaggctgagagacccccatgggggtggccggtatgctgaggcttgtatgggagccagatatcccacatcccatggggtggttgcctcctcctgtttccagcctttccagtgaggctgcaggaaagagacacagctaaggcctggagactcgtggcactccgtcagggcatggtaccacagatgagttgtaagcctgcgggacacagcatccaactctgaaagccccttgctcgaataaccctacatcaccgcctgagggcttccatatccttggtctcttcagactgtcatccccaccacaattactccaagaaattactgtcatccccaaatctataactggaaactgaggctcaggaaggagacatgacttccacaaaatcacacagttgggaaactctggagtctgcactcaactggtctgcaaaccgactctcggagacttcaggtgagatgaggtcaggttctcaggccaggtcctgaagtttgacaccttggcgaaatgcactttccttgactcagcaccgcagtgacggcggaacgaagccccgagcagaagggcttttcttcccagctgaagaggcagctcagcctagaccccaggcatggcactggacacccctgctgtggaaacgtgcagatttagatggaggggattcctaacctgggcaggatccgagtttggagagattggcgcgaagtttagcagcaatctccgattcctgtacaaccatagctgggtttctaagcgtctagggaagaaggactgggcccacgacctgctgagcaactcccaggtcggggactggcggaatatcagagcctctacgacccgtttgtctcgggctcgcccacttcaactctcggggtctctccgcctgttgttgcactcgtgcgttctctgcccctgacgctctaagctttctgctttctgcgtgtctctcagcctctttcggtccctctttcacggtctcactcctcagctctgtgcccccaatgccttgcctctctccaaatctctcacgacctgatttctacagccgctctacccatgggtcccccacaaatcaggggtacagaggagtattgaaagtcagctcagaggtgagcgcgcgcagccagcgtttcccgcggatacagcagtcgggtgttggagaggtttggaaagggcgtgccggagagccaagtgtcagccgcctagggcttgccggtcgctccctccctccctgcccggtaggggacctagcgcgcacgccagtgtggaggggcgggctggctggccagtctcgggcccctcggccaccccggggaccccccccaagccccgcccccgagtgttcctattggcctcggactccccctcccccagctgcccgcctgggctccggggcgtttaggctactacggataaatagcccagggcgcctggccgagaagctaggggtgaggaagccctggggcgctgccgccgctttccttaaccacaaatcaggccggacaggagagggaggggtgggggacagtgggtggggattcagactgccagcactttgctatctacagccggggctcccgagcggcagaaagttccggccactctctgccgcttgggttgggcgaaagccaggaccgtgccgcgccaccgccaggatatggagctactgtcgccaccgctccgcgacgtagacctgacggcccccgacggctctctctgctcctttgccacaacggacgacttctatgacgacccgtgtttcgactccccggacctgcgcttcttcgaagacctggacccgcgcctgatgcacgtgggcgcgctcctgaaacccgaagagcactcgcacttccccgcggcggtgcacccggccccgggcgcacgtgaggacgagcatgtgcgcgcgcccagcgggcaccaccaggcgggccgctgcctactgtgggcctgcaaggcgtgcaagcgcaagaccaccaacgccgaccgccgcaaggccgccaccatgcgcgagcggcgccgcctgagcaaagtaaatgaggcctttgagacactcaagcgctgcacgtcgagcaatccaaaccagcggttgcccaaggtggagatcctgcgcaacgccatccgctatatcgagggcctgcaggctctgctgcgcgaccaggacgccgcgccccctggcgccgcagccgccttctatgcgccgggcccgctgcccccgggccgcggcggcgagcactacagcggcgactccgacgcgtccagcccgcgctccaactgctccgacggcatggtaaggccgggaccccaggaagtgaggaagttagggcggcgctcgggatatcagggacgcgtttccgagggcggggagctggccttgcgggaggtttgggccaggatccttcccgagagagaggacccccttgtcctgggcagctgtcactggggtagcctgttttggaagtgtgcgggcaagcgttcgagctgccccattgggggcgctattagaacactgcagcgcgaacgtgaagatctttttctctacttatccctacttccaaaatgtaaatttgcgccccttggtgactgtccgcccttggtttggccctgcatgttgcagacctcatctcctacccacccgtaattacccccccaaccaggacaggtctgggcccggaactagagccttaggctagagttagggagggggcggctacaggaattggtgttcgggcctcgagccgtcccgcgggcctgactcagtcgcccttgctgtttgcagatggactacagcggccccccgagcggcgcccggcggcggaactgctacgaaggcgcctactacaacgaggcgcccagcggtgggtattccgggcctctccctgctcgctcctcctccttcatggagctgtcctggcctctatctaggacgctcccacccccactcacacacgcctatgtcctgggaagtggtgcaggagatgaaatactaagcaagtagctccctgtcttttcgattgtcccggactctaactaaagtcctcagtttccaatctgtctcaaagtactgggcccgggggtgggaggcttgtcgcggccccacccctgcttactaaccgagccctccccgcgcagaacccaggcccgggaagagtgcggcggtgtcgagcctagactgcctgtccagcatcgtggagcgcatctccaccgagagccctgcggcgcccgccctcctgctggcggacgtgccttctgagtcgcctccgcgcaggcaagaggctgccgcccccagcgagggagagagcagcggcgaccccacccagtcaccggacgccgccccgcagtgccctgcgggtgcgaaccccaacccgatataccaggtgctctgaggggatggtggccgcccacccgcccgagggatggtgcccctagggtccctcgcgcccaaaagattgaacttaaatgcccccctcccaacagcgctttaaaagcgacttctcttgaggtaggagaggcgggagaactgaagtttccgcccccgccccacagggcaaggacacagcgcggttttttccacgcagcacccttctcggagacccattgcgatggccgctccgtgttcctcggtgggccagagctgaaccttgaggggctaggttcagctttctcgcgccctcccccatgggggtgagaccctcgcagacctaaccctgccccgggatgcaccggttatttgggggggcgtgagacccagtgcactccggtcccaaatgtagcaggtgtaaccgtaacccacccccaacccgtttcccggttcaggaccactttttgtaatacttttgtaatctattcctgtaaataagagttgctttgccagagcaggagcccctggggctgtatttatctctgaggcatggtgtgtggtgctacagggaatttgtacgtttataccgcaggcgggcgagccgcgggcgctcgctcaggtgatcaaaataaaggcgctaatttataccgccgtggctccggctttccctggacatgggtgtgggatcc

SEQ ID NO: 118 - DNA, 18 bp, artificial sequence
  MYOD1 forward primer
gagcgcgcgtagttagcg

SEQ ID NO: 119 - DNA, 17 bp, artificial sequence
  MYOD1 reverse primer
tccgacacgccctttcc

SEQ ID NO: 120 - DNA, 30 bp, artificial sequence
  MYOD1 probe oligo (6FAM--TAMRA format)
ctccaacacccgactactatatccgcgaaa

SEQ ID NO: 121 - DNA, 850 bp, Homo sapiens
tttccgagtccccgtggggagccggggaccgtcccgcccccgtcccccgggtgccggggagcggtccctctgccgcgatcctttctggcgagtccccgtgcggagtcggagagcgctccctgagcgcgcgtgcggcccgagaggtcgcgcctggccggccttcggtccctcgtgtgtcccggtcgtaggaggggccggccgaaaatgcttccggctcccgctctggagacacgggccggccccctgcgtgtggcacgggcggccgggagggcgtccccggcccggcgctgctcccgcgtgtgtcctggggttgaccagagggccccgggcgctccgtgtgtggctgcgatggtggcgtttttggggacaggtgtccgtgtcgcgcgtcgcctgggccggcggcgtggtcggtgacgcgacctcccggccccggggaggtatatctttcgctccgagtcggcattttgggccgccgggttattgctgacacgctgtcctctggcgacctgtcgctggagaggttgggcctccggatgcgcgcggggctctggcctaccggtgacccggctagccggccgcgctcctgcttgagccgcctgccggggcccgcgggtcgctgttctctcgcgcgtccgagcgtcccgactcccggtgccggcccgggtccggtctctggccacccgggggcggcgggaaggcggcgagggccaccgtgccccgtgcgctctccgctgcgggcgcccggggcgcgcaaccccaccccgctggctccgtgccgtgcgtgtcaggcgttctcgtctccgcggggcttgtccgccgccccttccccggagtgggggttggccggagt

SEQ ID NO: 122 - DNA, 20 bp, artificial sequence
  RNR1 forward primer
cgttttggagatacgggtcg

SEQ ID NO: 123 - DNA, 18 bp, artificial sequence
  RNR1 reverse primer
aaacaacgccgaaccgaa

SEQ ID NO: 124 - DNA, 21 bp, artificial sequence
  RNR1 probe oligo (6FAM--BHQ-1 format)
accgcccgtaccacacgcaaa

SEQ ID NO: 125 - DNA, 181607 bp, Homo sapiens
tgtatgtatgtgtgtggtgtgtgaaggtgtatgtggtatgtgtttggtatgtgtatatgtgtactgtgtggtgcatgcatgttctgtgtatttgtgtgcatgtgtatgtatgtgtgcccgtctctgcatatgtgtatgtatatgtgtgcatgtgggtacaggtgtatgtacatgcatgcacatgtgtgcacatgtgtgaatgcatgtgtacatttgtgcatgtgcttatgtgtgtggatgcatgtgttcatgtaaatgcatgcatttgtgcccatgcacatgtgtatgtacatgtgtgcatatacatgtatgcactgacatatatgcatgtgtgcatatgtacacgtgtgcatgccttctgtgcatgtgtgaatgcatgtgtgcatgtggatgtatatgtgtgcatgtctgcgcatgtgtgtaacctccttagaacaggcagaaattggggctctggaatcctttctttgcctaccgcagttccttttaggctgtcttcatagagaaagggatagctcaaaacccacagccctgctttggcctgatgggggatttctgggtctcctcagtctgtcttttattaggcaggccatgggctgtcaggccctggctgggtagatgctctgctcatgaataaaagatagaggcagggcaggacagggccctccctgatgggcctccccgccgttctgtgtggtggaatctcacagtcaactttgacctgtgcacatccacttttttttttgagataggatcttgctctgtcacccagctgggagtgcagtggtgccatcacagctcatttcagcctcgacctcccaggctcaagcaatcttcctgccccagcctcccaagtagctgggactacaggtgcataccaccacacccggctaatgttttgatttctgcagagctaaagtcttactatgttgtccaggctggtctcaaactctgggctcaagagatcctcctgccttgggctcccaaactgctgggattacaggcatgagccactgcacccggccaacacattcacttttttgggacatggcagggacttaatgttttagaaaacatttagctacccctttgacaatgctgcttgacactatttgacagtgtgacttaccacatcctaataacttccatgaaaatcatcacaaagcaaattttaaatttttattaaaaatcacagtttttaaaaatgtccagtgacacaatgtagctcttctgaaatgaatggaaaacacaacacactgctaaccagtggagggagctctctgcagggctgggagacctgacaatgcagctgtagcctctgcaagtgaaaatccaggccgacttgcagtcattggactgatgtccaagtgcaatcaccatacagcagctacaggcagggctggctgatagggagtatgggagaaggacacgctcagatgaaaacatgcatgcaacgattttcaccactgaacacactgttttctgtgatagaaactgtcggccctgctgggggacaagatattcacggcctcactagccagtgtgatgccaccagggcagcctgcccctgatgctcctttgttacctgctaaagaaggaccataaggtaaaaggcaccttaccttatggagtgagcccagaccccagggaaaagcttgggtagaacaatccaaggggcagcctgggtatgagaatccagcccaagctagctgctctagaagcctggaggcctttcccagcttcccaaatgtagcccttttcacatgaccaatccttcaattaggttacctttctctatttgccctccttggtggctacaggggaaaggataattattcctgaccacaagacacattttcactagaaaagacttcctcgtgctggccacagtgggaattctgcacacaggtgcctgctccaccaagcagagaggctcaggagattgtccagggacaaggagacctggccggacctctgcagggaggtgaggcccctgcccccatcttgtcccatcacattctggatgtttggcatccccaggctcctgggaggggagaagtgctgataaaaaggccaaaaatcacacagaaagaagacagaaaactccacgcacttcctacataggtgctaccgtattcctacgagcacggggcctgtgttgaagactccctctggaagttacagaaggaagccaccaagagttcagcctcacagcctctttctcagatgcagtcaccactttaccaaacttggcacatccaaccactcctttcataattttacacctgtttgtggcctggctgacagatattttgtcattgatctttctaatttcagggattctaaatgtgttttgagaatctgctcagcactcagggattctgtctttaaaaatatgattaaaccaccagatagtgtgatttcagaaagtgtgcgtggctaccaaaaacttctaaacacaagttatatgagtgactcctgtcttctgtggctgagcttgggtactgattgtctttctccatgccttgcatcccctgttagaggagggcctgctgtccatggctgtccatgcactttaaaatgtctcaggtttagctgaagaccagatgggtccaagtttatttatatctgctggcataagaatgatggctaaattacctctttaagttgtttttttgtttgtttgttttgacagagtctcgctgtgatgcccaagctggagtgcagtggcatgatcttggctcactgcgacctccgtttcctgggttcaagcgattctcctgcctcagcctcccgagtagctgggactacagacacatgccaccatgcccggctaatttttgtatttttagtagagatggggttttaccatattggccaggctagtctcaaactccttacctcaagtgatccacccgcctcggcctcctaaagtgctgagatgtctctttaactttcaagaggtacagcaaaactgaaatcaatgggtgatgacttcttaaagatcaaacatgaagatgaggattagttaagaccagaaaatcattctccgatcttgtatcttcaactcaaattcacactccaaaaggcctgtttgtggtgaggctcagggtctttggcttgttctgaattaatactttctttggaaactctttagatggctttgatccctgtgctgccccccattgcagacacagaaagcgacaggggattctggcggcaccctctctgtggaggagaggaaggtgtggaccacgttcagaggaaggcagcctgaagctgtcctcagtgagatgctgggggatgggcctcttgcccctgctgtgcagcctccatgcagggctttatttaccagtcaccaggtcttcaagacagtctgcaggagagaggatttcagggggaaagtaagccaagccaattcattctcatggtccccttttatcacaaacatgtaagtcttccatctcataacagagacagcaaaagcagtatccaggccttttttttttttctttctttctttccttaactggctacatgcttagaaactgcactggtcaaacttgattttctttttaaagcctcaaaacatttttattgtcaggaaagcttttcagtggccagggatcagtctcatggccgtagaagcagccaaattcctctgcctttgccttcccttcaggagtcacatgctaaggcatccttgggcatttggaaaaggccgcttggggtgagagtgctctaggccactctgcaatgtccctgggcccgatgagtaacaaatgcaccccgggacccagagaagtggaaagacatgaaagggatttggaaacagatcgtaaaaataacctgtatgaaaatcacacagacaagaaaacaaacaaatccagctagccccttggatcctgccatccgtcttttctcccgggactgcctttgctttgtggagggtgagtcctgggacaggctttgggtgacaagttgtgggcatgttccatccaagcctggctctcccgactggcagagggaggtggctgacaatcaattcctctggatacattttcctgtgattgctcctgtgatcaaaggcagccaccgacaggtgcgggagcggttagttcaccacgtcatagtagtaattgcgcagccgcagttccactgctgcgaatccgggcctgttttccacactggaatggaagagatgcattcttgtttgtcaatgtgcttgtgaaaaattgctgatcacaagcagggcctctgcaggctgagtaccagtggtgctgctccctggtggctaactctagggcctgcagctcacagcgtggtccctgtgccccccaccccagggtgaccacaaggctgtcaaaaatagtgtcggcctactgtagacctaaataacccatatctgcactttaacaagacctcccggtgattcatgtccaccctaaagtaggagactttttgcattagaactgggagtgttttagccccaggttcagatatgcggcacacaatatgcttctgtgccacaggcaacacgaagaggctgtcactctgtgattttagcaaaacaggtgtctgaaaatacttggcaaatgttctgcagatatagtcaacatctgactcataatcttgttaagagaagaaatacgaacataactttaattctccctttccacgctctaatcgatggctctggattttctgaaaatgggctgttgatatgggttcttaggaaagctcaaaacatgtcatggcaggagcaaagacccagggcttgtctatgatccaccttaatatagccagtccttactgccactgctggccagggaggcactaatgtcagtaaactatgggcaaaagcattaacagttcgcagtctctaaacaaacacttacagacacttctgttttgtcttacacagacatcctgtacagatcagttggaagtaagtactaaaaccctgataatcgatcctcacttagaagttatttttcttattttgcaagatttctggatatattgcaagtgggtgaagttgaaatacaataagtgaaaaagtgaaacagaatgtgaggttaaattgtaggaaaccgtccacattcagccattttgacctatatcaatggcaatttcatatgattcaatgtcgacacaagagaacagccatagaacgcgcatcaggaccaagactcactcatcattataagagcagagtggcttctacaaatcaaaatgggtagctttgtcaaatggcatcaaaatacatggtttctcttatagctttcaatagtgagcaaaatgataaaactgctcgaattgatcagtgtggtcagccatctgtggtcatgtctggggacacgggcctcccagggtgtcactgagaggggctttgtctctggccaccaagtgtgttccgagaggggatatggtggccaagcctctggtacaggagcatgtgtccacccagagggacagcctctgtcttgctcctaaacttctacagtcaaagagaacacacttcagcatctttgcaaaacagggggctctgctccaactgtggggatccaaatggtacaaagagcacctttggatcttgctctgggggttcatctgcccagcagccaaggagcaaacaaatgcagggaaacaggaatacagactcgtcctcaggaaaaacacctggtcaggtctcctaggaaatctctcctgtacatccatgggagatgctgcctccaggaagctgggacacagctgtgcttcagcagcaggagggtgatgcagtgcccttgcgtgcccagcttcctggcctgccctggcctgccactctgctttcgggccagagtgcagattctgctctgctccttgtacccagtgaccctcctcctctcccctcatccctgcactcaaccttgcttcttagcctgcaggtctcagctgcaatccctaaaggcggcctatctggagcccctgctggaagtgtgaggcttccctccccataattttctgttctcttttaaagtttccagtgtgtgattttatataaagagatatatggtctttatcctgggttcctggcacagagctcctaaaacccttggaatttcctgattgttgggctgaaagcagcatcttttgttactcataataaacccccttcaaccatacctgggtttgtgctaatgagactatttctctccctccctccctccttctctcccttcatctacctccctcccgctctctctgtctgtctctatatatcaccttggagagagtggctgtttactactgaggaaaaaatgaaaaaacaaagcaaaacaaaacaaaacagagaatatactaggaccacctgtagtcccttcattgaatccaccacattctagaagctccaatgtgcttctgtgctgcaggcaactgtgagaaactacttcgacacgagagggcttaaaaaaccccatatatacacgtgatatcctccaggcccctgtgccctccttgcttagaattcccactggagtcatccctttcctaagacacatcataggacacacttatttttagcttattgtttattgcctgtctgccccagccccaactataaggtctgatagggacagggtctgaggcttctgtgaggcttgcacctggggtggcagcctgcatagcaggagctccggcagtggccaccgaccctgtgaatgacccagggctctcagaggatgtgccgctcagaggaaagccttggagctgaggttgtgcagggagccaggggacatctcaccaaggtcctgggaattcatgttttatcttgggcttgttgatctttaaacaggaatttgagccgcatctagagcctccctgactctcagagaacctggagagcccaggaaatttctccattcggcagaggcccccactggagggctgggactattaggaaaccgtttttcaggatcaagagcaccaacttctctccatttgcaagggctttccccactggtgtctttaatcaccccaagcatgacttggctctggaaaacactacagtggaaggcttcctgactgattcctgcttttcttagggccagtgtttccttcctggctttcacgctgcctccttgagtgacctgcacagggcaggactctgatgttgtgtttcctctttggaaagtgagagggggaaggagtgaagcatgggccatcccaaaatatgccagattgggatattgattattttgagttgaaaatattggatacattgtagtttcggataggactaactgacctgtctcttcatgcctgcagcaagccataaagattcctctgggaaggagacccttcctgtagcaggatgagaaaatgccccttatcatcagagactgggcattggagctgcaatgggcctgagtaaacatatttaacacagtatcccttatcttccactggttttacaccctcctcatatctcctagcgccttctctagaaaatttactccttctagccagattttatttgtcctgtcatttctccttaaatgtatggttctttgtctaaagattataaaagcatgttgttttggccacttctttagacttcactgtcttgtgaggatccccataaacatgtaaaactagtaaaattggtaagcttttcttttgttaatctggcctggtatcaatttggtttctaggtccagctgaagagtccattaagactaaaaaggggttggaggtaatctctggctgtcttacaagggtgagggatgctgtctgccttctcagggctttgtcattgaggctgggaagtccctttgaattccctccaggaccacaccctggaactgatgacaatgcctgcagtgagggaccccctgcatcttctggagggcctcaagcaatagcctgggttaccaggaccagcccttggcgcttctgagttctccttgtggccctgctccaaggaatcttttccttttttttcattcaactgcacctcattgaatttcttatgtttagacaaagtgattcagagctagaaagaaattatttaggcagatagtgagggtaacagagtcctctgtaaggtttccttgcaataaaaagcagctcctaaatcatgtcttttataacaaaaagcagcctgaaaaatcaagctgcaagcatagctaagcaagctaaaagctcacataggtaaatgccggcagctgtgtcaatagaaaagggatccctggagccagggatattcaacatggaggttccctcttccactttccttgttgccacgtgtgcagtaaaaaagcaggcaacaaggctgaggcgggcggatcatgaggtcaggagatcgagaccatcctgactaacacggtgaaaccccgtctccactaaaaaatacaaaaaaattagctgggcgtggtggcgggcgcctgtagtcccagctactcgggaggctgaggcaggagtatggtgtgaacccgggagacagagcttgcagtgagcccagatcgcgccactgcactccagcctgggcgacagagtgagactccgtctcaaaaaaaaaaaaaaaaaaaaagcaggcaacatggcgtcggccaaggagagacctcatctgcataataaaagattagggtggggcagccagtttcttttcgtgttatgtaaatggcctggctgtccaaccgatctttgggccctatgtaatcagactcaagctcgtctataaaacccttgcatttccacacggagccggaagaaccacttgggagcccttgtctctctgcaggaaagagagcttttctcttttctgttgcctattaaacctctgctcttaaactcacttcttgtgtgtctgcatctttgatttccttggcgtgaggcaacgagctcaggtattaccccagacaaacacagctgcttcaaaagtttcagaacatctccccacctcccccaaccctgtttgaggtcactactagaaacactgtaaccttcagaaatatagctttgttgggaaataaatcaaagtctgataaagagctgtgatttctaatatggggcatgggccattgtcatgatttccttttgactggggcttgtgccctggagctgactcctccaagcctgcagaactcactgaaatgcacccctgcagagcggactggggtgggaaccaaggggaaagacattgcctgcctgtgaacctcactcaggttccatcttaaatctccaggcgggaaaatacgtttagaaagaatactctcttaaggagactgttctactgctctactttgctgtaattctggtgaacatccagtgaatatcacgtagactgctttccctccccggtctgcccctggtggaccactctggaaataactgcccactgttacgtgcgtccatggaggacagaggtcggcccagcagcccctatcctgattccttgagtcacaagaatacaccacgagcccaaagggtattcagcagcctcactgcacccacctgggagccaagtgggaggtggtgcccctggctgcgcaccctgctctcttcccacccacctttcactcctcactgttaaacacacaccacaaagaagaatcgacagaagtacatagatcagcatcaacgttaaatgcaaaaactcccccactgcgagttcatttttaattcaaagtttttgcatttgtatcacaatgttttaaactctaccctcctcacccttctacaagaagggaagccttgcaaagggagctgcaggctggaccaaagaacactttcagtaaagggtcataggctgccacgtgcccaagggctgccctccccagggtccagtgctgccagtgcctacctgccaatggttcttacgattctagtttaggcactgggagaattaagccaagacttaggaataaacatcctcttagatccatgagtagcacttccctcttgctgacacttagctctccctgttgcactaacacttggggttggagaagatgctccggggcccaggccaggctcctctcctgagccacggcagcagcaggggcagggaagcatatacccacagtttgcctgctgcctttgtggctgccccctgggtggtttctagatacagaatgagattatttccctgtcactcacaattgtggtagagtgatactcccagggtggggaggggaggtctcggaatcccaggtggcatctgcagcatttggaatagccctcatctttcagaggctctggcaatgtcagctgtatctgaaggcaaacctgattccgcaaagcatcaaatccatggccaggatttgtgatgtcctcctgatcacaaaccacatcgattctcagctgtgtgggctctgtgtgcacagttcagtaccagggaactggagatggcggcttggggtcaccgtgctatgcacgcacaagcaggctgctgagcctggcaaaactgtactcctaattttcagtggcaatgcattttccttccttgctgagctgccctgaacatcacctaagaataatgccaggtgtactttaaaagcataacagcacctgggatccactaagcgagacgtatgacggcagtcagggtggactgaggccaccacttcaaggatgaggtagattctagggaagtgcaaccttagccaatgtatctgtgagctggccagagtccgaggtcacccctcactgctcatggtaatcagggagtcaggaaagtataccatcccctaccgagtgcttctgccatcctctatgccaaaaatggcatccagccccaaactcttacaaacacttttttactttgactgcccttgccccatctctccaccattatcgacatttaaatttggacactcgggttagagtccccatctaaacttgctctttaggctctactacatgtaagtgcatgggccagaaagcaaggtctctaaagcaagaccagcccccaccgttgtttgtttagaaagcgggcacattcctgattcatgaaaaggtgaactttatccttttttttagacgcccaaccatttcacctgtttccagagcatctgaatacatcacagtcagtgtcaggtactcactcgtatgtccagcacagattcatgagatcgtacatctctcttggacaccctgcagggcaccccatccgctctcctttctctaacatagcggtgacttcacttcctttcatcccctacaacatgcaagatatgcataagcttttttttttttaaaggtgttagtcaaacaaaacaaaacagccactccaagacatgaaggagtacacattgtatgatttcaattatacgaagtataaaaacaggagcacttaatctgtgatgttggagtcagttgggtcacccctggggaaggctgtgtgtgcagaggaaacaggcttctggggttctgttcttcatctgggggctgatttcatgggtatgtttcatttgtggaaaaccactgtactgcatgctaagagttgtgccctttttggtatatatgttttaattaaaagatctaaaaaatgtaattaagatactgtaaatagtcattatttctatttcaactctaatgagtaatgatctgggttatattttgtgtatatttacatgtgttgacacacaatgggaaaaacacactcttcagtgagcatcagatatttcattctcagtttggaatagactgagggcacattaactgcttactggtaaaagataatgagagactcagattaggattttcaggttgttgtaaagacaatctggtgcttatctgttctaatggccccacagtgagaaaatgaagcaggactggctcactcgatatggcttctgcccataggagaatgcttcccacatcaacactccaaagctccagacatcgcttttgctggagaacttgtagtagttgatgcattccggagcgtaccacttgacaggccactttccatgggtctgggcctaaaagcaaagcagagggagaaattccattaagaataaaattgtgggccgggcacattggttcatgcctgtaatcccagcactttgggaggctgaggagagcagatcacttgagatcgggagcttgagaccagcctggccaagaggaaaccccatctctattaaaaatacaaaaattagccaggtgtggtggcgggtgcctgtaattccagctacttgggaggctgaggcaggagaattgcttgaacccagaaggcagaggttgcagtgatctcagatcacaccactgcactgcagcctgggtgacacaacgagagactccatctcaaaaaaaaaaaaaaaagaaagaaagaaaagcataaaattgtgtacattcatgttcatagcagcattattcccaatagctaaaacatgaaagcaacccaagtgtccttcagcagatgagtggataaacaaaacaccctctatatagacaatggaatagcattcagccttcaaaaggaagggaattcactacaatatgcatgagcctagaggacattatgctgagtgaaattgagacaggagaatagggcctggaggcagggaacctaaggacttcctagaactaaatcaaatggaaacacttcagctatgacaggaaatatcctcttcatttacacagggtgtacactcagtaaatgactttgtaacattacttcatcctcctcatttacatagggtgtacaccaagtaaataactttgtaacttcactttagcctcttcatttacatagggtgtaccctaagtaaccagtgaacacctctagaggtgtatatatatatatacacaccacattttctttatccattcatccatccatggacagttaggttgattccacatctttgctattgtgaatagttctatgataagcacgttgagtgtatgtgtccctttgatacaagtttatttgcctctggataaatacccaatagtagacttgctggatcatatggtaattctatgtgtagttagtttttttttcttctttttgtttttgagatggagtctcactctatcgcccaggctggagtgtgcagtagtgtgatttcagctcactgcaagctccgcctcctgggttcatgccattcttctgcctcagcctcccaggtagctgggatgacaggcacctgtcaccaggcctggccaattttttgtatttttagtagagacagggtttcaccgtgttagccaggatggtcttgatctcctgaccttgtgatctgcctgcctcgggcttccaaaactgctgggattacaggtgtgagccaccgtgcccagcctgtttttgttttgagaagtctctctaatattttccgtagtgactatactaatttacattcccacaaacagtgtataagagttcctttttttcctgcatctgcaaagcatttttttaaaaaaagtctttttaataacagccattctagccggggtaagatggtatctcattgtgtttgtaatttgcatttccctgctgtttggtgatattgagcattttttcatatacctgttggccatttgtatatcttcttttgagaaatgtctatctatgttcttagcccactatttaacaggattatttgtatgtttggtttaccagtgagttttatacttttgtgtgtttttatgatggtaaatattgtccttttacttccacgtttaagattcctttgagtatttcttctaggatcagtctagtggtgatgaattccctcagtgtttgcttacctgggaaaggctttatttttcttttatttatgaagaatagttttgctggacatggtctccttgggtggcagtatttttctttcagcactttgaaaatgtcatccccttctctcctggcctgtaaggtgtctgctgagaaatccactgttagtctaatggtggttcctttatgggtaattagaagattttcttttgctctttttagtatatttgcttttgctttgactttaagtggtttgattataacgtgctgtggagaagatgattttgcattgtatctgtttggggacctttgggcctcctgcatctggatgtctaggtttgttgttatatttgggaagttttgatctaatatttcattaaataggatttctaatctttcattctctcttcacccttggggacactgatgatttgaatattcagttgctttacactgccccatatatcatgaagggtttgctcattcttttttattcttttctctttatttttgtctgaataggttgtttcaaaagacctgtcttcaagttctgagattctttcttttgcctgatctagtctattggtggagtttgggatgtattttttattgcattcaatgaatctttagttccagaatttctgtttggttcttttaaaaatatctatttctttgataaatttctcattcatatcctgaactgtttttctgaattctctctattgtttttcagaattctcttatatcttatttagcttctttaaaatcaatattttgaattgttcatctggggttttgtgaatttctttttgattgggatttttttgctggagaattgtgtgttcctttggaggtatcatatttccttgctttttcatgtttcctgtgttcttacattgatatctgcccatgtggtacaacagtcatttcttccagttttttgaaattgcttttgtagaggaggtctttttcctgaaaatatatatatgttgttgggtatatatatgttgggtatatatatatatacacatatatgtgtgtatatatatacacatatgtgcatatgtatatatatgtatatatacacatatgtgcatatgtatatatatgtatatatgtatatatgtatatacacacatatgtgtgtatatgtatatacacacatatgtgtatatgtgtatgtacacatatgtgtatatgtgcatgtacacatgtgtatatgtgcatgtacacatatgtgtatatgtgtatatgtacatgtacacatatgtgtatatgtgtatatgtacatgtacacatatgtgtatatgtgtatatatgtacatgtacacatatgtgtatatgtgtatatatgtacatgtacacatatgtgtatatgtgtatatatgtacatgtacacatatgtgtatgtgtatgtatgtacatgtacacatatgtgtatgtgtatgtatgtacatgtacacatatgtgtatgtgtatgtatgtacatgtacacatatgtgtatgtgtgtgtatgtatatgtacacacatatgtgtatgtgtatgtatatgtacacacatatgtgtatatgtatgtatatatacacatatgtgtatgtatgcatatatacacgtatgtgtgtatgtatgtatacacgtatgtgtatgtgtgtatatatacacgtatgtgtatgtgtatatgtgtgtatatatacacgtatgtgtatatgtgtgtatatatacacgtatgtgtatgtgtatgtgtatatatacacgtatgtgtatgtgtatatgcgtgtatatatacacgtatgtgtatgtgtgtatatatacacgtatgtgtatgtgtgtatatatacacacacacatatatatatgtagggcactttgggtttgatttggggtgaatgcagtatttaatctatgtataatttctatggccataaacagcctcagtgacacctgtgattttctcagtgccttagggtatggttattagtggaggctgttgtgaaggtgtactgtgaataggatgctaggtgggccagtcttcagaccccagtggtgacagcagtgagctgagtatgcctgtccttgggccctagggcggtatacactagcactggtgttagtaggtctaagaaggctgacccttgggctttcaggtagattgtgtggatgctgcagtggctgggcatgtgggcaggttcttgggttcctggggagtgggtgtgatgtgggtgatggcagtaatggtggtagggcaactcactggaacccaagtggtccatgttggtgttggcggtggctgcaacaggatgtcatgctcaagtattggggcatgtgactaggccaatggacttgtgctcaggctccctggtggtgcattcagctgctggctgtgatacgcagggaggggtggtctctaggttgccagcagtggctgccctgaaggcctaccaccagaaagggtagggccactctcaataggtgcagagtaggcaggtagctgtgggatatgcagtcttcttgagccttggtcccacagcagccctcagcagtggtggtggtatttgtttttgtggcatgtgaaagtgcctggcctcccttctccctatgtggcggggcagtggcagcatcagccctggcccaaggaaggacacagacctttggaggcttggctctcagaatggcgctggctatgggcctgctcctggggaggctgcggacattctcagggggagcagtgtaggcaggcagctatagggggtgtgatttgcttgtgtctcagccccacagcagcctgtagcagcagggggatctgtccctggggtgtgtgaaggtgtccattctcccctctgtccttggcctggtgatggcagcatcagcaatagtcccagggcaagatgcagtcctttggggacttggttctcagtatggcaccaagctgcagctactcagagcttggaagcctgtgggactcagcgtgagttccctctatggagcaatgcctctgtgtgatccctaggcagctccctatgttagtcttaaggcccacgtgggtcgaggggttcttctgtcgctaggattgtagaagtccttggctggaatgtggagccctggggatctctcatttatgctttccccatatctggaagcttctcccagctcccagtcattcctggccaagcaggctgccttgtttccctgtgctttgcttttggtgcttcctgtcgctccttggttgcatctgtgttctctcttagaccatctattggaagtgtgaatatgtacttgttattttggtccgtctctacggaggagcatatactagttgcatttagtcgtccatcttgatcagttctccacccaggtcaattattttagcatgcactacttgctagcatcattaaaaaatgatctaagcattctaatttcctaattttaaaaagcaagtgatagtacagaggtcaaaactgcatagcaaaaccctctctctgggtttgggattcagggggcacacagcggagtctggttatcttctgctgatgtcacctgtgtgaggtctcattggggtggagagggggacatgatttcagtgaaaactgatttcatgacactacagtggatcacaaggagacattcaggacatcaatctggagaccataaggtgccctggcacttctcttccaaatgatacaactgattatacttctgtttccatcaccttgtgtgctattttaaaattttgatcttacaagtcatgaacaatacaaccatgtgtgttatttcaggtttcttctgaattttgaactgatgaaaaaagtaaacctttgacaaatcttaaatgcaatgaaatttaggctgtcttcagaataacctagatacatgcataaataggtagtgtatacttttttctggtcataaaactaggggcatattctttgagcactgtactttttaatttttctacctaaccatgtatagtagacatatttctaggtcagcacatgcaaataagtcacttttaaaagggttgcattgtgagcttcctgtgaatctgctatgactgattggaccaaaccctgcggagcagtcgtcaggcagtttccagatttttgccgtggcagcccgtgctagagtgcacattaccagatgtgtgtgtttgctctcggaaggagctgctggatcaaagaacacctgtgtttttcagttgtgatgctgcacaaatctaccctgtcacgcatggtttcccgagtgccagcgttcgtttgcttccacagctagcacttttctttgatcttgtttcactttttattcctttttttttttgagacagagtcttgctctgttggccaggctagagtgcagtggcacgatctcagctcactgcaacctccacctcccgggctcaagcaattctcctgcctcagccaccagagtagctgggattacaggtgcctgccaccatgcctggctaatttttgtgtttttagtagagacgggatttcaccatgttggccaggctggtctcgaactcctgacctcaggtaatccacccacctcagcctcccaaagtgctgggattacaggcgtgagccaccacgcccggcccactttttattcttttccatttcactttgctttgttttcatacagaaatcttccactaccctatcttttcggtagttttgtctctttttgctgcttccaagatggcttttatttccctagtggctttttttcttcattgattgtccaaagacaatctttggtttactttttagtttagtttactttttaatggtatgctgtttaatatctacagcagttttagaattggccccatgttctttgactctttgacacttctcctcaaaagggtggttctatctatcccatcctttgaagctggtggccttggctgctctgaccaataggatcaggtggaagtgaccctgaggtagtttctgggcctggttttataggcctggcagcccccacttcctgcctcttgggtaactgctctcagcccgcagctgccatgctgcccaagggaagcatgggcccaagggaagcccaagggccccaaggagaggccatgtgcaggtgagctggctgacagccccgcagaggtctccagcatgggctgtgtctaaccagctgctcagtggctgagtagtgtgagtgagcagagtggaaacggtcctcctgtccctcgggccactgtgcaatcccctgtgtgagcagacgcactgaaccctgcctacctggccctgcccacacagcaggacggcagggaaaccaacacctggtggtgtttttggcagtaagtttggggtgatttgttatacagcagtggataaggtgcccagcattcatgtttcattttctctatctcctctgtgtccttgtttcagacaggctgtcttcttttctgtaatgatcatgatgaggtacatccagcattacaacaggcttctttctccagcatgtcccatgctggtcatcctaggctgctgtcttccttgctctgtttccctgctatttctatccaggcccatgctgatgcctttctcacagtggttcacctctgaaggggcttccttctgggaagctactgtatgaagaatggggtgaggagggccagcctgacccctgctgtactctcgcctggcctttgtgctcaagatggtggagtctgcctgcctgcctgggagcttggctcttgtggcttacccttcatgcagtccctttgctggccgaggtccaccattccccatcacctaccagtccatggactgcctcttagggaaaggtgagtgggtgggtattgtcactcagggtggggtctctgaccactgcagggcatgaaacacaggatcctatctgccacccactaggtagattttgaaggtctgccatctatttctgagcatgtggacttcaccagagactagcagggttgttaacctgccttcggcaccctctttgactcagtgggattggtgccatcacgttttccagttggttaacatagaccctaggtatacaccacagatgagttaatatgaagatagagctttcttatcttttcttcttttagttgttattggttcatttgagggttcagagaggggtcaagttatattagcaaggggattggtcactgtgaaattattttttaggaagtccaaacctgcacccagaactagtttctactttatgttttgctggaagtccacccttaattcttgataatctctgcctcaccaaaccaaggggcatatttcttttagcttcagtcacataactatctagatctcttctttccagcactgcatctattttttgacacttcaactcttctggataccagttaagccaatagaacaatttctacatatgtagtggacatacacagatgacgagtttatttggtaaatcttcactttctaacttttgcatgtataggtaggtgttcattagaaagttattttggaatagctccaagctgcaatattggagctctgaactgcagtactggagctccaagctccaatagctccatgctgtgggacagtgttccaccacatgttatgaaatgtcctatcagaaaaggatgccatggatgaatctggtttgagaaatgcagtgcagtaaaccctctactgagattcgtaatgttaagtagcatgaaaagggcttcggggaaatcctgcaagaatcaagctgtccaatgcaaacttttcaaattaacttaatgaaggaatcccattcttcttttttcaaaacaaatcttcacttaatacctcgattcctgatcattccatgaaacataatttagaatatactactttgagtaaatctcaaggtgtgatattatttttattttttaaacagtaaaatcaaagattataagaacatatcttacatagttatttttcagtagcaaaactgctttttgaaaccataccaataataaaataaagaaaacgtacatttatcttgcattttttaccacctgctgctctgaatattagctaagttgtacttaccttgtagtagttttcatcagcacgcagtgctttggaaagtccgaaatcactgatcttggcgtaatgttgggtaactagcaacacatttcttgcagccagatctctgtgcacaaaattgctctcctccaagtacttcatgcccatggaaacctgatgaaccagttctatgatgttcttatccttgacatgtctgaaagtcataatgatctcatcagctataacagacagtgacccatttcacaacaaacaaccatgctcctcacgcaggcagtgggtgaatctactccttccctcttcttaaacaacaaaactcacgagtggtgacaaataactttgttagcatatagctcttcaggactcaatgccatattctcctggtgttcaatgggattgagtttcctggcatgcttggaattgcaagaaaagcagtataacagagtagtcaggcctggctcacagatagccaggcaccacctcaaatccttgttccagtatcacacaggtcacagaactaaccctgagaatcagtttctcacctacaaagtcagggtaagaacacctcccttccatggagactaaagagacaatctaagtacaaacgtagcacagcaaatgaggcaagctcctcggtggccatcattctgtcttactccaagtgagtttcttcatctcaacaacagctttagatgagaagaacacaattactcccttgatggatgtaatcaattagcagtgattggtattttcagaagtcatcactcatgagaacataaggtcagccaaacagataagacttaactgtcacctcttagaaaagcatttatttaaaatgtttctttaaaaagaaagtgttcttcccagtgagaaaggagattccatgtcaagatattctgaggctgagtctatcactaggccaagactgaatgactacaggaagaaaaaaaagacaaaactgtcaaatgagttcttctctgaacaactagagctaacagagctgaatccaaagactatgtctccctgtccctctgtcaaggtccctgagtatggaccaataaaggaaggcacaggagggtgggaaggcttcccaaggaaatcaggctgctcggcccatccaggggtgggccctgtcccttaggggatagcttccagatgtgtgggggcacctgacaatacctgttctgctgcaaatacttattgaggggaccaagttctgccatctccataaccagcatccaggactcggcctcgcatatcccgatcatccgcacgatgtacgggttgtccagctgctgcatgacatttgcttctgctaataactcatctttaagagcggggtcattggcctcgtttttcagtattttcacagccacggttttcacaactctgcaagagaaatcataacacacaagaaactttccaaaatgcctcacttctagataatcttatcctgtgaagcataatccccctgtggaaacagtcccacggaaatacctgccacagagtggcaatgtgtcttcagaagcctgtaatggatggctggccttccaacctatattcccttattttatagacaatgagagtaatactccattactaaaaaagaatggtgggggctgggcatggtggctcatgctgacaatccccatactttgggaggttgaaaggggaggattgcttgaggtcagaagttcaaggtcagcctgggcaacatagtgagacccccatctctaaaaaaaatcacccaggtgtgacagtgcaagcctgtagtcccagctgctcgggaggctgaggtgggagaatcacttggactcaggagttcaaggctgcagtgagcttcttgccacttcactccagcctgggtgacacagtgaaacactgtttctaaaaaataatataaaataaaaagaatggtgaagaacagtactgaagaatgtcccaaccaagcaaaaaccctaaactgtaaaatatttaaataacttgtaaataaacttcaccaacgatgacatgtacgaattcctgtaacatcttgggattcaccatctcagattacatgtaatgaatgtgaatataaaatgcctttcataattgttgaaagtgaatttctaggtgcagaatttaaaagcatatatttcaatgtaatacattgaaaaggtaaacaactctcctgagagaggctgaagaagacctggtaaatggagagatgggctgtgtttatagattgaaagactcagtattgtaaagacatcattttgccccaaattgaccgagagagcctctcctctccccaaattctctagttgaaattatgtccacagtcatgtctatgttaattcacaaatttaagcacagaataaagatcacaacctttcataatctgaaaaagcttaggattaatacagaaacatttttactcattgtacaaaatgactgtgatatacaaacatatattttaaaataagtatcacagccaattttgattgtgtgtgtatatatgtgcgcatgtatatacttgtgaatgtatacatatgtgtgtatgtttgtgtgtgtatacatacatgtatgtgtatctaatttacacacacacacatgcacaaaaacaaatcgaagggacagattggaaagcaagcatttcttttttctttctttctttttttttttttttttttgaggcagagtttcactcttgttgcccaggctggagtgcaatggtgtgatcttggctggctgcaacctcttcctcccaggttcaagtgattctcctgcctcagcctcctaagtagttgggactacaggtgtatgccaccacacccagctaattttttgtatttttagtggagacgaggttttaccatgttggccaggatggtcttgaactccagacctcaggtgatccacctaccttggcctcccaaagtgctgggattataggcatgagccacggcacccggccggaaagcacgcatgtctgtgtatatttttgtctatatttttaacccttgaatcataaaaattacctactcacgaattttttttttacaaaaatcccttacatttgaaataccatgaagctactaaatctaaccacattcatattagtatcataccaattcaaacagagggtgtatttcaaaggactttagaaaccagtagttttacttgtacattctatgttgggtaccttctaaagaccaaaagaaatacaaagatattttcgaaatttagcaattttaactgttgtataatatgtattgttatctgaaatcataggataaagccaataaataattatactaatcatatttggaatcaataattttcatgtaagaaaaatgagatgtaactataaaattaaagaaaataaatgtaaaaactattgttataatggaatgattttgttttaattaaataatatctgtgtgtacaaataaagatctaaaaatatatacaataagattaagttaacagtagtaatgtttagttaacagtagtagtgttgggatggtattatacaaatatgatgttcttcttttcttttttttgttttgttttttgaaacagggccttgctttgttacccaggctagagtgcagtggtgcaatcatggctcactgcagccttggcttcttggcctcttgagcagctggaagtatatgtgtgcactactatgtctggctaattttttatgttttatttatttatttatttatttattttttttgtagagacagggtcttgctatgttgcccaggctggtctcaagctccaggcctcaaacaatcctcctatcccagcctcccaaattgctaagattacaggcatgagccaccatgccaatttgatgtttttattttcttatgtttctgcttgtttctatttcctaattttccataaggtgcatgtactattaggttggtgcaaaagtaattgcagtttttgccattaaaggtaatggacgctttcattataatagtaccagaaattaacaagaatggtagcattaataaaaaaagggtttagtcatgccaggttacattttgttattctcagtcatgtctagaacctgagctcatgtgagggtgaggctggtggaacatagcaacttactttttcatttggtagtagccctttttcacagttccaaaattaccagagcccagttctttgtcttccagcgtcagcagctttcggtccaggtaaacctccttgggcctgatctcctcggggtccgcgtaggggctctcgtacacctctgtgtccatgggtagggcttctctctgggggcctgcaatgcagtcaagaaacatacgacctggggctggaccccacaccaggattcatccttccaagaacatgatcttcatgggaatatgaactcagagtagcatcaatgttgcaagggatgagaaattctgaagagtggcagggacatttccaacgtcgttgggtgagggaggtgggaaagaccatttcattcaatagcaccatcactgctcatgggcatgtggtgcctgctgcctgccactagatgtgagtgtttccatggctaactgtggctgtattgcaatcacggacgtggtgtggattcgtgaaccaactctacaaacttacaagtgaccacgcactttgctctgtgaatgtcccttgaatgaaaggaagtctcacctttgtctgcagcccagggtgcaagttctggctcatacggattgaatgacacagtactctcttgccggttcccttgggcaggggaggactaaagtacataaaggacaacaggttgtttttcttcatccacaaaactgttaagttgatctgcataattatttttattttccaataatcacagtttaacttttgcaggaaagacaaaggaaagaattacgaaaaacagggaagaaaataaggctgatctcattcttcgggcaattatttggatcttgcaagggctaaagcaagcttgtgctgctacaactcaagggactctgtgaggtgttcagagggtgtggtgagagtcaactctactggcctggatagagctgcttccccactcacccccttgcacatcctattcccacctaccaaagatcgctgatgatttgcatgttcgccttggaagcattttccttctttaacttgtgctcttcaatttcatattacatggacattatttaaagaggaaaattagtactcatcagctgctcctacctacttcccaactccaacgcacatatgttttccaagtctccacccaagtctttatcttcggtggagatgcagcagcattggggtggatggcagagggtggcactggtcagtaactacaggtcccaagggaaggccagttgctgccacctaggccagcaatgctccagctgccacagctaatgctggaaatcagtacccctgtgagacaggtatttatttggtccacatcagtttatatcatgaaacaactggggggggaaatctactcattatcctaaggactttcccttttgaaagtctctatcttgagttttcctgacccaccctttcttccaaattaaaacaagattcttgctactaaatttaattcacaggagaaccatgattcagatgcttttttttttttttcagcgtgagttgagtcacaattctatgtattgattgaccttttcagtgcccaaacactggccacgaagaaatgagatactgccagattatggagaaagttacagaaacagagacattaagcttaacgtgacagtcacttatcttatgacacacactaaatcctcatgtgccttattcatattacaaggcgagaaaccaaaagcagaataatgaggtcacaatgcaccactaccgccactcagccattgtttccaaacacccggaccttcttctttcacacggtctgctgagcacttcagaggcagacattgttcaccatggcccaagcctgttgacaaggctaaaggacatctggtcttatttgtaaaaatgatgtcgatgggatctgttttgtcacagagtatctcagcacttctactgaactgattaacagaagtaactatgacacatcaaaaataaaaatagaatataagctcaaggagggggagacatttattcactgcactcggaactgtgccacgtccacaaggacgctcaataaaaatgtgttgaacaaacacatgaatgaatggatgggtgaatgaatgaaaatcacttctaaaaactaggagatgtgaagtataatctaatgtgctttaaaaattagctctctctcaagcctttatgctgatgaagagaaataagaatgaataattccaaatgacaatctatttcttttaaacatttacatatgattacaggactgtgctgtggtttcacttctgatttataatataattatcctgcctctggaaaactgtcctgacagaaactgggtgatcccctaggctttctgtcctcctcttttgcccagttttctcccgcaaccaattctaggctgaaaatagttttattttttttaaagtctctttcaaggttaatatttactgtcatttcaactcctttgattttccctgcaggcaggcacattctgagatccaaagacaaaacttgaacagatgtggaattaaaggatgtcctcggactagccatcactggtgaggagagggaccatcacctcttcttgacataagacctcctgtccctcccactgaggacattatcctggggttgcagcctctctacctcacagaatgttctccagaccaggaggacttccaaatggcttgttccaattaaaccagaacgcaattccctgacatatgaatcctgcagggaagaattttaaaacagagatggggttgtcaaaatatgctgaaagggatactagggtgtcaggaatgagtaagaattagtagcgatggacacagagaatctaaacccctgggcacaaataatttatactctcactagcagtgtgttgttcacccctagtctatcttggcttatggatagggaaacagatgggagatcttcctcggaaattagaactccacgtttatagccaataaagcttggggcttcatttccatgctgcccaacacagaccactatgtgattataagccttttaagccaagccacaaagaaccctcatgtctctcaacaaccccacatcaactctctcctacccagatccctgggctccctgcccctatctctttctggtgactaacaggactggagcaaagaatgatgccacaactggaagaatgtggaagaaatgggaggtttcctattgagtcagttaaaagaacagtagttactttatgataaagatgaagatgcaaaatccatgcttcatctttcccaaagcacttggtgaatatgccacttagtagaacaataaccaaaacaatctctaaaagaaaatgctcagttaaaaagaaaaatttgaggagtttgtaaagaatgagcacagtggcataatgataaattgtaaaaatactattcttaaaaaatgtaatgacatttaattttaataaaaaatatatttccggtctacattactattaaccttttattctttatgtttgcatttgagagagccattctgtcccaatcaataagtgtcatctgttctgcacagtgagcaacaaggtgtaaatgaaatgttgaccattccactttcttcatttttgctaatactcagaacaggctcaaaccttcagtccaccgctagatggcattagccaccttcgctttctaccttccaaaagaacaactggtgacttttctttaaattttataaattcaggtaaggatatcactctgcaataataagtccagttataaattattatccctgatttcctattggtaaggtttaactgcgaatagaaaatgtatttgacaagcattctttgagtgcctatgtttaaaagctggtgatccaaaagtgaacaaaagaggaaaaaattattggtctgtggaactgataggtccattcagagtttcctgattccagagtattgccaagtgtcctaacatccatttactagatcttaatttttactcccagattcttgggccattttcaaattaggcaacagcagtaatgcagatgacaatacagtcattagtcatcacaataatagtgacaaaagagccagctggctttagaaatattggctgcaataaactaggtttggtttcctttttttggtggaattaccctggttcagtagacccccacaggcgagggcagactgttggctggggaataggctactattagctttgctctgagatccatgaaaataacacttgacctctgcaattactgttctcttacagtgaagatctaaaatctgttcctttataattatatgaaaacacattttctcaagggtctggtctactaaggcattaccaagcaacagggtacaacttgaggatgtttctttcttttttctcttcccactgagccctgtacttaaatgtaagttttaaaatattataatcaccaatgtatgtgttggaataaaacatgaaaaatgggttttaattggaaattctgggacacatttcagtttaatcctcttaggggatgtgcctttgaaatgcaaagctgaaaagttccctggaagtctttttagagatgttgctgtttaatttccacctattttccataaaagaaggataaggttctgtgcttaaagcagcagagaaagaaattccaggactaatattgggaggggtttaattcatttaaagactactagttgtattcttaagttaattttgtttatactttataagtatgttactaatttcttttcttttcttttctttttttgtttttgagacagagtcttgctctgtctcccaggctggagggcaatggcacgatctctgcaatctccacctcccaggcttaagtgattttcctgcttcagcctcctgagtagctgggattataggcgtgtgccaccacgcctggctaatttttgtatttttaatagagatgagttttcaccatattggccaggctagtcttgaactcctgacctcaagtgatccacctgcctcggcctcccaaagtgctgggattataggcatgagccactgtgcttggcagtaagctactaatttctaaagacaagtttaaaatgcatcagcctgttagtaattttatgaaaaatttaaattatctgattcataatcatcttcaaatctaaacatacttttcattaactatctagatgctataggtagttcaagttctaacatgtattttttgtgcctgaattattaaaacaactatgtacactgagcaaattaacaagttcaagaaagttatttatctcttagctaacatgatgggacatttgacataattctcacaattcttttctcatgactgattacataatggaaagttccccatttgtttgtgaaaatatacatattagctctaaaatatttctgataagcaattaaaatatttttaatctatagcttaaaccttacaaccttgatcttttaaaaattatctgttgatatttttggccttatatatgtgtcatcattagtaatatttatttccagtttcttatttctataaaaaattcaatgtatactttaaagttcttctaaacttaaatagaaagcaaacttttttttttgccagaaaggtattttcacaatattaatcagattaattactctctactatttaattttctgttttaaaaaaattgattaaaatttcttaacaggttcaaatttaaaaagatacaacagagtttacaatgaaaagtgggatttcttaacattcccatctcttactccagaggcaaccagcattgccagcattttctgtatttttctaggatactgtatacgatatcaacacattctgcatatatgtatgtgtatgtgtgtgttgcaggacattgacttttacacttaaaattatattttgaaaacaattctagatctcagctgcctcccatagtagcaattttactgtaaccaatttcatttgttttccattgataggcatttaaattattatcagactttgtcaattatacaattttggaaaaaacaccttcacatgtacatgatttcacacaaatgcaagaatatctgtacatacttagaaataaaattgcagagcctttcttacagattgcatcatttcagacttccccaaggaagagtgaaagtgcttatctaccatgcctttactacagtgttatcaagcttttaaaatttggatcataggtggacacagttaagcaccatagttttaacttgcatttctcttctcatgaagttaaacaacatttcatatgtttaagaactatttatatttgctttactataaactactactgatattccctgccaattatcctagtagacagttaatatttttgttaattatttttagaatctctttgtatattaaagctattaatctatgtgtcagcattagtgctacttactcccagtttctcatttctcttttgatgatgttatggttgttatctacacatatacttctttatttttaggtggtcactgatattttcttcaacttttttctgacatgttctcctgtagtctaaagatgcaccaaaacttattttctaggtatttctttagccactgtgagtaatctgtgggggtgttttgccttgggtaaacatgaaaaacagacatagttactttattcaagtgtaaaataaaccttttcttcctctcgaacactgcattaaatctttctgttctgtggtcaacacgattgagaacttcttgagtatgagtaaacttggaaaattattactaaataaaatctcaagggttttatgtcttttatttctgttgtttctagtaaatactttaggcaatctatttcatgagtggatgctcaattatatgctaaaatgtcggtaaaaacaccaagtaatatgaaaataaaaagaattactgataaaagaaccaattttaccccactgataataaaagtagaatggaaaaaaagcaattcaaacacattatatatacatattttgggggaaggaataaataagtcattataaataaaagtcatgaaaaagaacttatttttattttccctcaaaatccaataatagaacaaaacatggaaatcaatgagatgtcaacattactgcctcaaaaagaaaactggtttttctagacctcagattacacctcttctttacatgtcacatttgcagttctatgttagacgtctaagccataatgaagttaccatgcactgcctgacctcactgtgcagcgcgcctcacaaaaccttggtgttccctccatcacaacgtaacttacataatcaattaccagaacactgcaacacgtgagtctggccaccaaaaagtaagtgggccatctttgaaaagattttcggacatgataattagctatgacggatgacgccaactgaaacgactttaaaatgacgcttgagcacagaaagcatgctcacactgttggacttccagctgacggactgaggacccacatgaaaagcacatgatgtacctggggcgcggctgcccaggaacagcaggtgtgagcaagggcaaagaggcctggaagcagagtggcaagagatggggggcagcgcacacacagggcagactgggcgggcgggagctgagtgcgcgttggtcctaccacttagttggacagcaagcaggggttgctttagcacctttctgtggccaggctttgggaaggagtatgatttgattcttgagattattccacccgctgaccaagtctagaaaccacaacggcaaagaggaacagtaaatgtttcagaaaacaaatacaggatcccttccacgacatgctacttaaatttgcttctataatcgcaccactaaccccctcctgtccctgccaatgagatcgaccacgggcaacacctgatcattgggaaggcttctggaagggcctgccacttgggaagaaggatctagaaatatatttgggaaatatgttccactgaaggctacaaaattagagctgttacattcactagctcatgcttcacgtggaattattaagttgtaagctcaagacaaaccaccgaaagaaactacaagtagatctgagtgctcagttgtgttgcttcttcatggtgggtgctggttccacggtggaaaattttgtggaaattaattgagttgtacacatagggcgtatgccttttttttcccgtatgtatcttaccagtcaattaaaaagttattccaaaatatctaacttcttgtagtcattgggtgatgatggctaagcacagggcttgacattcttttaagagttctcagccctaagccctcatccatctgaagggtgtatggatctgtctcaccgagcctataatattaagatagagttgccaggcctgtgagccctgtaaagggcaaaataaagtcacacttccataaaggcattacattttgatcccaaaggtcactggtattttagcaaattcacgttccctgcatttgataacaagtgctgcccctggacagcctcccctgtttcaacctgggctcagctactgggcagccaattgtccctactggaggcaggatgtatatttggctttctgcagattttgtttttcaagggttaccaggcaaaaagtgaggtgcagagggcgcacttcacagatggcattaaagggcataaaaagtccatatgggccgggcacggtggctcacgcctgtaatcccagcactttgggaggccgaggcgggcagatcacgaggttaggagatcgagaccatcctggctaacggggtgaaaccccatctctactaaaaatataaaaaaattagccgggtgttgtggcgggcgcctgtagtcccagctactcgcgaggctgaggcaggagaatggcgtgaacccgggaggcagagcttgcagtgagctgagatcgcgccactgcactccagcctgggcaacagagcgagactccgtctcaaaaaaaaaaaaaaaaaaaaaaaaaggccatatgtagccccaagaaaagagcaggaaaataattcctgcttagagcataaatctgtacctgacctcctaacaggctggagggaggagacagctgaggtcctgtgaattacgtgtgttaacatagacggctcaaggatgaagctaaaaaatatgttcccatttctcaaatattgcaagaggcctacttctgatttaatattgggtttcattcgcattgtgtatattctccaaaaatgaagagaatttcatctagacaagaagttaagaaaatgtggctaggcagagtgtggtggctcatgcctgtaatccaagcactttgggaggtcgaagcaggaggataacttgaggccaggaatttgagaccagcctgaccaaaatggcaaaacctcgtctctactaaaaaatacaaaaattagccgggtgtgatggcaggcacctgtaatcccagctactcgggaggctgaggcatgagaatggcttgaagctgggaggcagaggttgcagtgagccgtgattgcaccagtgcactccagtcagggtgacagagtgagacactccatctccaaaaaaaaaaagcaaaagaaaaaaagaaaagaaaatgtggttagtttatcactaataggaggctgattctgcctaacactcactagcaatcccagctcatcacggagtatgttttgaagcgcaatcaaaatatcaatgcctactactcctgttagctaaaacatgcttttcatttgtgaaatatgcaacagcttctcattcagtggtattcctagtgacacttaccgcaggatgggaacctggaagttgtggacggcctccaaaattaacatttcctggttagagagagcatggacaattactgctctatctgaggaaaccacttccttcccctccccactgcagatcaatcaatgagatcaggatgtgctgctgcttgagaagtgagcacgctttctgcaggtacttctttcgaccctcttttactttttcccgcatgcaatgaagacaaataaattacaatttttttaaagttaaagcaactggctattttttgattcacgatatacaaaatcggagtgctctgatatcattattaatcaacccgtaaaaagaagtcctcatccaacccaaatctgcaatcagctaagtctaaaatgaggctgattgtcactgatacctcaaacactgagactccagtgtcttgggaactcaccctgtgtgccgattttttgacatgggacagtaagaactcttaacaaaccatctgctttataagaataatgctcgactagctgaaagagaaaaaagtaagaaagtggtaaataccaaggtcaggaaatagacaaatagtgactgagagctactgactgactgttgggctttcgaagtggccccaagacacataaatgcttttatgtgcttaagtccactccacaagggtggctggggaagtgggcccacagctagggatcccccctcttgggctaggggcagcaaattttttctgtaaagggccagaaagtggtattttaggcttttgtgggcctcataccgtatctgtgtcctttgtttatttatttatttatccaaaacaacacctttaacagcatacaaaccattctcttcagggactacacagaaacaggctgagagccagagttggtctgtgggtttgcagatccctggtctacagtaaagaatattgaaatagggtattatggcaatcaccaactctccgtgaaatagcactggggccctggagttgggtagggtacagaagtaccttagaacgctgtcaagaaaaatcaatgaaatcatgcatgggaaattggaacgtattgctggcatttttgacgtagtttcctaaacacagtgcctagaaaatatacaatgaggaatatttaattagggatgaatgctatgatctaccaggggaatcaatacaaatagtaaagattcttgggaaggacattctcaataattagagatgcttaacactatggtgagtgctcagcctttgaaatggtgacagaacgccacacacataaaatgccctttcaggagaaggtgaatgaatggctgtttataagtgatggggcctgggaccttggagcattaagctggcatagaggactccaggtgcctttgcattccagaaggccacattccctactcacctccctgatgtgctttggggctttgagtgtagaaaggttaaatactctttcgaatcaatatcgttaaaagaaagaagcctgtggttaatgatgacaaatggcaatgagccacaaaatcaaaagacaatgtaaatgttgtgactaacattttttaatatgatcatatccagcattcaaaaaaggagtattttttttttccaattacagcactagaaagcaaatcacatttggaagtagtaagtttaagtgctttaaaggggctaaggctctgtagtctcagtttttgaaaagacaggattttgagttgagtcctttcctcaacattgactgcatgtgtggccccagctgggcttgggtgaggacattggaacacgccctgattatgcccctcacccacacatgttcaaggtagctggtgctctggggcggtggggtggtggcagagtcggttggctttctccctgtttctgaacctactacagtttataggatgctctgcgaagatgatgcacgaagtactgttacggttatttccttcatcatcagccagtgtagctgtgatgcaaaattaagacaagcaatctgtgctcactgcgattcagggaaagcagtgatgagcattattttagtgctcattagtgcctaaggaacttccaaattgggagttgtttcagggttttctagtagctgggtcaggaataagcactttttagaccagggctgtggcaatcagcataagcagcagcctggagcccagggagtatgcttcctaaattgccttagtttccacagagagagactcgatttacaatgaggagggcacctgacatttgctgtctaattcagcctctcacaccaccaacaaagtcctgcttggctgttcctaggcctccttccccaggcatccattcctttattttgtgtgtctttgtctgaaaggctgttctgggctctagttagaatatcctaggaagaaatattttctagatctccaaagagagtgtcttgttaaactctgaacacagccctgcacttacatcaccttgtggcactgagggctgagtggccctgaacaagccatggaaccttcgttcacctcacatgacggcctctggaccagtgcttctcaaacacagaagccacctggaggctgaaagtggggtctgatgggcaggtggggcaggagcccaggtgtggtccaggtgtgtgtttctcatgagctccagagctactgctggcctggggaccacactgtgggcagtgggtggtccagttcctctcatgtctaagagtccatgggacaaggagccccacgtgccctgtactctacccacaaggtggggagaggaggctgggtacctgccagagcgtgtcgaacttctttccctcggggatggagagcttccctgtcttgtctttgtcgatgcgatagtgcagcaccttcccttcgtgcagcaggcacagggcgtaggagccgttgttgtctctggctcggatcctagaagagaggatggaactgcatcatccccaggcccgccagtctccaggtgggaccctgggaggaagcaccctggcctgaatggtcagcagccgctctctggggcctgtcacctggcaaggcagctggagggcagagtttggagcctcagggtcaagggctttacccaacccaggaaggcccagtttaccactcagggatgatgccagtgggcaagcttgcaacaaggaaatgctagcaggttggtgatgaatggaccatggctaagctctagcagggcccaggagctctgggcagtggtcaggagagcctggtgctcagtagcagtgacgcttctcagggtgatgagcacaggggcaccacgggccctgattatctgtggagcactgtggactcacctttcttcaccagggcctgcatttgggttagatccaagatggacagctctaccacctagcttggagtgtgggtgggggtgtttggtgggcattttaaccagccatcttctggaccagagatggagggttatggaagcctccatcccccgggccttcctcagtccctcccatgctcccactgcaggaaagggaggcagggctggacttccactctcccactgcaggaaagggaggcagggctggacttccactctcccactgcaggaaagggaggcagggctggacttccaagctcccaatgcaggaaagggaggcagggctggacttcaaacagtttcaaatgatgatattgtcgggtaacacccccaggagaagaaaatgacatccactgtggggtgaagagacagaggtgaaaccagagctgtgctggccgtgctgagcagccaaggctctgtcttcatggtaatgctgggcgaccctcagaacaaccccctgccctgggtcctggtgaacagaaacacaggagtctgatgccaggcagggaacaacacccccactgcagtgcatgccacgtaaggcttatgactcatggggaggtgagagatcccctggaagacctgtgggacttggggagttcgaggtcccagtggaggctgaaaaggcacgaaatgggtgcgaatcccccagtttagcttcgtagtcacacacactgccccattctcccctctccacagctgcagccctttggttcatgagatcttaggttctgagggtgagtcatgaagtcccaggaagcctctttggcccctgcattttctaaaatgaggaagctgaggtccaaaattgttaagccacgtgcccaaatgcactgtacttggggcagagttcaagtgtgcccaactgccttgggacgtctgggtactggggaaatttctgatgcctcctcctggttgcaagaagtcagatacacgaccacagggagagttgagatggccttcagaactggacatggccatgctttcctgtcccttgccatggagacttatctcaaaaagctaacccaagacttgaaagctgaacgatggcatgggaggagtgaaattcagaataagtgtcttttctagcggtgcttggccatgcacagcaccccacagctcagggcagctggccagggtacaggacacatatctaggttctctgtggcctcagcaggtggctgtgctgaaacctccccactgtgagaacaacctcttcttcccaaaccaaccgagttgccagcgcccaaggtgtgagctcccttttcacagccacatggccgactacagccagcagttggtgactgttaaatacaacacaacacaacacaacaaaaaaccacatggtaatcttttcatataaagagagaactgagtctgttttatagggaaagtatcttataaagtgagactatttatgtttattctatacatatcagtggcttatagtttgagggtatagagagctatccaaatactacagcagtaagagtggatgcatatgcctataaaagttggccttgaaagaatggtgacaatatgtcactccaaagtatttcctataatttaatcttttacgtctgtgacctcaaggtcatggagataatacatgggatctgaaccaggtgcagtggcacacatctgtaatcctagcactttgggaggccaaggcaggaggattacttgagcccaggaggtgaaagctgcagtgagccaagactgcaccatggcactccagcctgggcaacagagtgagacgccatctctccagaaaaaaagatagtagtaataaatgggatctgaactctggtttctgaatccatgtccaatctgctgtactccatcttaccctatgtcttgattgacattttcttgttaaaaactgagacagacaagcacaggtttccctgagagatgatgccatcaacctcattaggcatctggcaaacatgaatgaagaccccagggaagtaccattccacgctcttcagactggtggaagttagaaagatcattctaagtgctactgagagtggggagcagcaaggcccctcctacgttgcttgtgggagcataaatgggctcacccactttggaaaacaatttggaacagtctcctgaaactgaacttattcattcacagacctcgtgaatgagcaattccacccctaggtgtatgaaatgtgtgcactatgcaccccaaggctacttatagcagcttcatctgtgcttatcaaaaactgcacacaacgtaagtgaccacagagcaagtaaattgtaggaattcacacaatactgtattctaaagcaataaaatgagcaaatggtagctatacaaagcacagatgagtctcacaaacataaaactcactccatgctaccatatacacaaagtccccaaacagacaaaagccacctgttttatctagtgatgtacacctaggtggtaaaactaaaaaaacaaacaaatgaaaaataacaaaaaaagcaagggcgtgatgaacacaagagttcaggaggtggtgcctcccaggaggccagctgtacagatgggtatgagtgtgtgagggcggagtggtctcctgcaatgctgggtgcatttcatttcttgactgggttgtgtttgcttgataatcattcattaagttgtacctatttagttatgcactcttatgtgtttgttttatatttcacaataaaagcagtataaaaagagagctggtaccaggaggaaatagagagcaacccagaggaaacagagagtgccctttgctttggaacaagcagtttctgcaaaggcctcacttccttgaggctcttcaagaggacaggttctgcaggcgatcccctctcttcctgtgctccaccaagcagccctggccagtcctggcaacaggtaactggaaggtataggtagtgaccatggacatgtggcctgggcagccccctgtggcaggtggcaggaaacaagagcagagaaaggaaacccacaggcccagcatctgtaggtggcaaagaccagaaggctcgcgacattaaccaccagcaactgtgaggtatctgttggctgcaggcagatcctggaccaggccatttttaattaaacataggagacaaactgatttggaaggcttgctcctcctcttggctgtgtcctcttactgagagctttgccctggtggtggcatcaggacacccacccaggcttatggctctacagacacccagagagggcgtgcacacaggcaaggctcctggctcctgtctggcttgctgccttccgccttcagggtcatctggcctcaggctgttcacagaagcctttgaatatttacaaaatattttttcccagtaattgtcttgggaggagtaagttaacagatttgtgttttgctattgcaaagcctgagatttccagggcttgagcttgagatgatgctgagaagctgtcctaactggtcttgagacagtccttgacctgcggcatgtctactttcccagggtaggcagccttggcctctggggtgagcaggccttgtgcctcacagacactagaacactatccaaaggtgaggcatgttgactctgctggggcatggcctggaagggctggactcctctactctcctgcaccctcctaggggagagagaatatacagaggtgatgcccgggcaccaaggggaaagtgaggatgtaagaagtagtgaggcactcaaggtggcctccccagggctacggggacactgcctgtatctgctgtagacggaacagaaaagccgggcacattccagcccactaggtgttctcattctcccctgccattttttttccatggcagagtagagtatcaccgggtcagttgtcagactcatacaaggggaaggaagatgcctgggattggctgtgtgcattagatgtgcaaaggatgaatgctcactgtggctaaggtgggctgggcagatggacagagggggcctgtgctgggttgggtgggcagttctcactcagagccatctcccaacagtggtttctcaaagagagctgggagaggggaagaggaggatgtgggagcgaatgaggtcctgaacagtgtgtatgtcagcaagaggcaggagaaatgccagctttactgatccatgaaagatatagataatgcaacttctgagtgcttctgccttgcgccatagcactactgaggcacatgtgcattccacacaaagaagagcaagatcagtacacaatccctatctgaggccacaccaagctgttttaacacacctgtcgtttaaaacattttattacaaacgccctctcattctctccctctgctttagttcatgaaggtggaattatttaacgcatcttgtctttcagcttcaaggagactttgatcagcatcaatgaagtgatattgacatcagcccacaactctctttgaagttttaacttcagacaggtcatgactctttatgatgacctaggtctgcaaaaccacatgtgtcaaataaaatggcatactttgatcaattacggcagcatatgaaagcactgatggaacagagtttttgttgtggcaaaggaggctcgtgacagcctaacacagtctcattcctcaatgaacaaggaaaaggtttttcctaagccgcaaattcacttttgaaattgaagtataggacaaaaagtgagttgaaacttgaacagcaaaaagtgagtggcaaatgagagcaattaaagtgggtttggccaaagggccaatgccaatatcagcacagctgtggacagggacagaatctcaggccagcagcccagtgagcacctggatgtgggattcccaccttaaagcaaggacctgtgaagaggaaatccccttcaactctggaggaaagtgttcccagcatcgaatactcaggattcccacagattaatatcaatcaggcataagctcagaaagatcactgaaaacataaggaagcatgagttatgagaaaaggggtagggagggaaagagagagagatttacatcctccaaaagtttcggtagtagaataatcagatatagaatataaactatgaaatgtttaacaaaataaaaaacggaaccatggaaattagcaaccaataagatactctaaaaatgccccagaaatatttgaaaaaacaaacaaacaaacaaacaaacagaactgctagaaattttctaaaaaatgtaattaaaaaaaatcagtgaatgagcgtaagagcagattggacacaaatgaaggaaaaattagtgcgctggaagaataattcaacgacgttactcatagcacaggacacagaaaaggcaagggaaaataaaaaatataaaggatgaattgagaaggtcaaactgtatttaataggagtctctgaaggaagaaatgggcaagaacaacagagagcaatatttgaagaaaaaagtagcaagatgtttttcagaactgatgaaagaaaagaattcatggatgtaggaaccacagagacatgagaaccattggcttagctttatacacattacttaagtcatctccataatgactcagataaaacatcagtctccccattttattactgaggaaacagaggctcagagagcaaaattaagttgtccaaatcacagagctattaagtggcagggcctgtctgactcatggcctgaatttctttactatctaacttaagtttctagaaatagaggcattttcaaagataactttatcggaaccagtccaataatacagtatttgggcattttgcaggaattgcaactgcaaatgcagttacagaccctccaatgaactatgaaaatctcaaatgatcatagttgttaatccagcccaggtaggtaacaggtatctcaaacaggctcacaccatatccccagaccagcagcatcagcatcatttgagaacttggcaggaatgcaaatggaagagtccttacacagacctgtgaattaaaaactcaggggatggaacgcagacatctgtgcttttgccagccctccagatggttctttctttttctctgtctgtctctctctctctctctctctcacacacacccacacacacacacacacacacatattcactcaatagctcatttgtgcatcttaagttacgggctccatgggtggccctgcaggataaaccaatgaacaataagaatagacagtccagagaagttttgcaccccatttttttatgcagctaaggactagaagatacagtgattctggctttctaagaaaaagggttgtgtccaccagaatcaggggtgtgcaaatcagagccatacagccctcgtccaggagcaggccctgggtgggacccagcctggggacaccagataacatacctgtcaccttgaacatgagaacaacacctctcaccaatgctcacacccttcacctcccctccccagcaggtggcttgcatggcaggtgacgccttgctttggaaacagatgttattaatcctttgcagtgcaagtgggactcagtataagggaatcataaaaattttattcacgtatatcccatttctctaagaaattgagacagttcctaaagacatatacttcagtattctatatgaccaggaaacaaacctaaattaggataaaccacggagaatggatgcagtactttaagttgggccccacaggttgtgcacaggtccacaggagatgatatgcagccgcggttctcaagtgtgtgtgtgtgtgtgtgtgtgtgtgtatgtatgtgtgtgtgtgagagagagagaggcgggctgtagggggaagaagtgaggggatgggagtgtgtgcagacatgagggaaaggaaggggagaagagaggtggagataacgagtgtgtcatgctgcacctggaacttggctagtacaaaagggatgactcaaagattacactgcttatttcttttcaaaatggacaggggaaggaaggtcaggagggcacctgaatttcagctgcagggcatataagaacaagccacatggggattcagtggtggcatgggggttgggaaggggtgactaccaaggcctctgagggcaaactgcactcaccgtcggtccctgctctgagggtttctgcgctttttatctgatcctgcatacttggaacaagggcttcctgggaatcgttttaactaatgtattaaagagctatcatggaaaggagcacttctagggtcccaagagatcatgtacagcaactgtggcctgagtggagtacatcaggcccacttagctgcaggggacagtgatgttcttgcaactttaggacccaccaagcctgcaggcttcccatcctcctcactcactcttcaacatgcatgcctctcagatcgctgaggctcacaacctcctgggcttcctctctgactcagtttctctccagacatctgcaaactactgggcctgatcacagcccagctctccaggtgcctctcctgctgtgagccgtcagagcagccgcccctgctccatgctgcacactcggggcagctgagcagccaggatctctctcaacacctcatggtgtggcctggggcagccacgtgccaatccctccaccacccggccagtctgccaccatcaaggaaaactctgccaccatccatagaatctcagggcaccaaaatggtctcagggcaccacgtgaccatgacatggtgctgcctcctggggctcggactggggttctgtagatgcccgggctcctgcacacccactcggcatccaccgcttcacttccctccctctcctgcaggcatccaggcctgccctggccaccatacccatgctaccccgtgaatctcttgctgccctgctctcttttttttcttttttattttattttattttattattattatactttaagttttagggtacatgtgcacaatgtgcaggttagttacatatgtatacatgtgccatgctggtgtgctgcacccattaacttgtcatttagcattaggtatatctcctaaagctatccctccccgctcctcccaccccacaacagtccccagagtgtgatgttccccttcctgtgtccatgtgttctcaatgttcagttcccacctatgagtgagaacatgcggtgtttgtttttttgtccttgcgatagtttactgagaatgatgatttccaatttcatccgtgtccctacaaaggacatgaactcatcactttttatggctgcatagtattccatggtgtatatgtgccacattttcttaatccagtctatcattgttggacatctgggttggttccaagtctttgctattgtgaatagtgccgcaataaacatacgtgtgcatgtgtctttatagcagcatgatttatagtcctttgggtatatacccagtaatgggatggctgggtctgccctgctcttttgttgcatctgcctggtgaggtgtcaagctctgccaaatccagtcagcccacttgctctgaaggccacttcccagttcctatagttagcgacacactagatgatagtccagcctgggcacctgagacaggcccgatgaaccatgttgtccctcctcctatccaagtagtggccaccattcaagttagcagccagaatgttcctttacccagagagatttttcccaccaagaccatgttctaggtgctgggttgcactcgtgaaggcaacagccccatctctgcccttgtgcatccagcacaagtgggggtggggactataaacaagtaaatgaaaacaaaatcaagatcatgctgcgtaggcccagtgtcgtggtggaggggacctactgccatgcattgcagactttgcagcacatcagcttgcgtttgtcatcttccccctgcagtcaaagtccggtgagggcagggactaaggtctgacttattcctcacagtagccaagtcctatcacaatgcctgctgcatgtctggttgaaaacatgcctattttgttgaatgaatgactgtttttgtaacttttttttctaaagtcagaaggtagaaactgtagttaaaatagcattggtgacttactggttggacgactccatccacaaatctgaaatactaccttttatttttaacattaatcgagctatttggagagcagccacttatgtgtcttaaaggtcaccttgaaattgttcttggctttgtaagatttacaaggactcttagccaaaaacaatacacttaatacaaagaaacaatacttccatctttaaaattttgcctggcatggactttttagagcatttccattctaagatcatttataagatgaaatgaaggccacatcccattacattttagcagagcgatgtgtgtgggagaattggctgtgcacaatggcaataaaccacattgtgtgaaccaagtggatgagggtcagagaggagttgatcacagcctcctccagaccaagaggagcccagcaatgtgactgcacggccttaggttttgtacagattgcaaaagatattttagtcacagccagggaagctcactctgttctactttatcttcccctcccaaatttgacaaggattctaaaaatgtacatgatattattaataatgaagtgtgaacctagaggaaggaatgaatagtctctttttctatatatagacaaatatattattaaatattgttgaactaagatgtagtcaaacacagtgaagtcaaggacatggaggaaacaaaaggtgttatagagacgtgtcaggcagttaattaaaatattacattatcttttctaaagtttgtatgcttgtagtattgaccagcctttaaaaaaattctaatttattgaatttttttccttagtccaaaaaatacattctattgtatgcctaattttatatttttaaaaaaataagagagtcttcaaattgtatatgcttcggacccctcaatcctggatcctcccttttggggaagggatatataatttttataaagtaagctttgtttccttttcctaacaaattcatttttcacagacagctgtgactagcttctcaaaatagcaaactgtgctgctatacaaggcctctgggggcaggggatctccttccccactcagctcctctcccttgccttggtccctgacgtcaccaacaaggcagcactctgaccctcacccaccaaacgtgggctggaggactccccctccagtgctcgcttctggccagctagaccccagacaagggcagtgcttatatagcaaaggccaggtgatgaacatcacctccagaaatgccacaggcggctgtgagggacaaccactgacccacactgcccagcccctccacaaagagcctctgtttatattcgttattcttcaagcacatgtgcaaaggccctgtaactaccttctcaaagtcactcctgaatggtgtgggtaagctctgtggacaggacacaagagaggggaaagctgatggacgcctctgtgtgttctgagatttcacatggacatgccctggtgctgcatcttgcatggggaatagggaggggcctgtggttgtggagatggatccatctggagatggatttggttgctggctgctgtttctgcttagccccagacaacatcagggacctggttttgccttcctgccttggacaagctcctccacacccgagttcttgtttgaaaaacaataagtttagcccccttaagtggtaaatgccctctagctcaggtgtactctcactgtaagtggatttcacatatagttctgaggagagaaaactgggatccgagttggacagcatctcccagacgtaatctgcttccatcatctgcattttgaactgcattacctaggatttataatcagattttgatctccaaaatatgctgccttaccctcagtgttttcaaggtctgtttgagcaaaggcattttgtgatggctatggaggtgcatgcatttcaggaattcttttttttttttttttaccttttagtccaattcttaccaatgccactttccacgtaaagcgattctcagactgaaatgctggcatctgaatggtggagacagcatattggtactcacgatgaaagtgtgaagagtaatcgctgggattttgtttacccatattatccaccaaactagtaaaatcctcttgattagtttatggcttgcaatgcaaaaataaacttccaaccccctctgtgaaataataataataataatatatatattttttgagatggagtcttgctctgttgcccaggctggagtgcagtggcacaatcttggctcactgcaacctccgcctcctgggttcaagagattctcctgcctcagcctcccaagtagctgggactacaggcacacaccactatactcagctaatttttatactgttagtagagatggggtttcaccatgttggccaggatggtcttgatctctagaccttgtgattgcccgcctcagcctcccaaagtgctgggattacaggcatgagccaccatgcccggccgaaataattattctttatttaagtctgtcacttcataaaagcaaaagcctagtgtgaatccttttatggccagtgactctcactctatctattcatagccacagagtggaaataaacacacctactgcagactgaagaagagaagggaaggataagggggacctgcctggttttctcacctgcagaagaatgactcacctgcagaggtcatggtacacctgtgatgcagggatggaaagagtttgcatggaggacctgaccttcagtgtatgttactgatgtatccaagtgtggtccaggccactgcaggagtggggtgaagctgcttcgttcggtgccaagcaccgtgcagcaggccttcggtttatgatactctataaccctcaatgactctaagagtcagagatgacattaaagccattttacagacaaagaaatgaaggaaacagaccactgagtaacttgctcaaggtcccatagctggtgataaggtggagccagcatttgaggccagacaacccgaatggtatgttgttaacaggccacactgcctcctacccagagaaagtgaatcttacaaaccatagagtgcgcagtgtcatgtttttatatttctatatctattgctgtgtccctgcatctgtccatcagtaatgatttaagaggaggtagaaagaggtgcaagaatccccattccctccccaacatagacaggtgtggagctgcccccatacagaactacagtggtattactacatgtcaggaagtggaaagcaaaaacgagctgggagatggagaatggatccaaacaattcattgatttaggtgacaagcattcattgaaaacctcttaagggccagcccacaggcctgtacaggacccaggtaaaagcacggtgggtggggtggacaggagatcagagcggagacaaactgactgatgctcaggcatgagaaagtgaaggccctgaaatcacgataaaaaaatcaacacatttggtttgcaagtatatgtacaggcacaactccccacagcaaaccgatgatgtggcagccaggcagagcccaccgaatgtcagctggccctggccctttgcttcctaaagacagcccccccaacttgcccaaagcagggtcctcccagtgccgtgagtgctctgcaacctggccctcaactccacccttctccactcactctctgccagtgacactggcctctgtgggtgccctgctccccaggcacgctcctgccacagggcattcgaatttgccattccctgggtggggatggttcctcgctgccttcaggcctcttctcaatggcctccctcacagcaaggtccatcctccccacgcagcagaaagaagacccagcatccataccccagtgtgctctacgcccttacttaaatgcagttctttcctattgttcagcgtcttttctcccactgaaatgcagggtccatgagggcaggtgcttgctgattcacttctcccttcccaaagtccagaatggtgcctggcacttagtgcttcatgcaactacagactccagtaatgttggtccatggatggattagctgacatgatgattggaaagtagacatgagcacattcgttaggagaatctgaatgaaggcccgagaagaacagtgggaaaaaaacagcagctggctcagtgaggacatccagcagtgactggaatctagttctgactccaaagaccttgtgctgtggctattcgttgcaaataatgtgcattttataaaactatctgcaagtagggcagatttggatgattcaaaaccaggtctgggacttcctgcaacgttggcctgacccaacaggggaatataggacagactcccacagtgaatcaggagctgacgcactcacactgagagggcagccacaggatctggtgatggtttacaagagttccctggagccttttagctctatttcccatgaaagaaacacacaaacaaacacttctaaagatgaaagaatctggaccaacgtctaggcaacctggacttgggagacgttgtattcagggatgcagaccctgccccgtgctggaagcatggtagacttggactgtatccagtatgctggcaaactctccctgctctccacaagcatacacaaccatattcaaacactcacagtataacacgcccactacactgcaacaaggaaggtttacacacccagcaacagccaagaaccccagccaggttctgtaggagatgaaaggttgtcaagaggtgaaattgccaggtggcaaacccctccaaggtgtttcctcacactttctctgttaaaaacaccataagataccctgacaaggagactttcctggtgctcatgatggagaaagagcactgaagagagaagaaaagctacatcagtgatgaccacatgtgctgtgcggtgtacgtggtgtgtattttcattgaatcctcaagacagtcacagacccagaggagcagagcctggggaaagtttcccttagtctaaggttctacaaccatcatgggaacatgggttctgaagctgggtcttgctgcccaggcttagctctgctcttccctctcactaataccctgcctgatgccaggcctgggcatggggtgctatgcaccatcagtccacaggtgagccctgcaggtgtggagggagcacgggaaggtgtgggactgagctgtggacaacacaagggagaaagccttggaagctattatctgggaggttggcaattatggggtgataactggacaactgcaatataaagtggaataagaacccaggagaataagaacccaggaataagaacccaggagaagaagacaactaaggagagggtgctcgatgaaaacacagaagcccaggcccctctctcacaggcccatgcctggttagctctgacaccagctgaataggaagcacggcaagtttgagactctcttgcataaaccataagcctcagtgtcagggacatgtgctgtgaggacacatgagatgtcagtctgtacagggcagatagggaacaaggcatgttcatcaaacaagagctgcacctcccagccttctgcatggggtttatatacatctcccagaaaggaaggagagagcaaaagtcatggccatgaaggatgcaactgctgttttcgggaatagacaactccgaaaaaagaaacagcttcgtggccaaagaggctatgagcaggcttcttaaccagcagaagttggccagcctcatcgtgtggattatgctattttgggttgacttcacatgccaagatgctatgtgcatggtcccatgacattcatgttggaaattattgctgagatggtaagaagccaaacctcagcaaaaatagccataggtgcctccactgaggggcaatgtcttccctccccacagcattctgctgctggctggggctgcatcccactaaagaccatcactctaggcactgccgcgtggcaacctgggccactcttccttcttccttttttttttttttttttaagagtattgtggtcaatttttcttttctttttttctttttttgagacagggcctcactatgttgcccaggctggtctcaaactagcctcaaacgatagtgagatcatagtgaggatgaagcgatcctcctgccaggagtagctgggactacaggtgcgtgccactgcactcagctaagatcatttttaaaatacaaggtatgacagtgaagtctgaggaaattcctttgaatagatggacaggcagagaaaacgcttctaaatctaggaaaagtttacgaagtcggctggggattcaccaattgccaaaccatgaggctgcatcgctgtttctggttatgtttccaaggtaagcatctctgtagggacactgagaggtgaccaggggatcatttcccccagggacaactgccccactgagccaccttgaccagaccccctcgagggaacaaggttgacacctcccaaagacagttctttaccttctctggacaactgactgaccacgttggcctgtatctcagaaccttctacaatttagatttacactgaaccactgaggatagcaaacagaacccaggattcagacagaccctctaatgactgtgggcctaaggctgaagtcttcaaacctgcactcaccactcatggatgctactcccaggaacttttccttaacatctttcctgttggcatcttgtttcatgtaaaatagaagtaaagtctgagatcaagggggtagtttgagtaaaaaaactgcagtattttaattttagttggataaccacagaatgtgctatgcaacctataatttgccattaaaaggagaatatggggctgaatcacattttctttaaatattacatccctcggtgcccaaaaagagtgttcattttagagttagactgggcaaaataaacactgggtcacaagtgatagctttggttagaaatgtctttagaacaggccagcatgcatgttgtcaaatggcaatgcatggcctcttcccagggtcatgtggggccagtcacaaggaagctgaattattcccaattgtccacacaggcctggtggcaggaggtgagggggaaggcacgatactcacaggaactttccatttgtctttgatcctatcaggacaatttgctcagattcttcccgagagatttttccatggaaccaaggcattttttcatgggctgtggtagcgatcagcttctccagctgaggcttctgactgatgatggcctgctccagagcctgaccctgccacatggagagcaaagcagagtaaaccataccgaggaaaaatgaaaatgatgcagaaggcatttccaatctatctcgagtcctggcatggtaaaacaggatcaaaacttattcactcattcattcagtaaataaaaccagaaagacctttacacattacttaagtactttcaagtgtataaataaaaataacatggccgggcacggtggctcacgcttataatcccagtattttgggaggccaaggaggatggttcacttgaggtcaggagttcgagaccagcctggccagcatggtgaaaccccatctctactaaaaatacaaaaattagccaggtgtggtggcacatgcctgtaatcccagctacttgggaggctgaggcagtagaatcgcttgaaccttggagccagaggttgcattgagctgagatcatgccactgcactccagcctgggtgacagagcaagactctgtctcaaaaaaataaaaaataaaaaaataaacacacatatcctttgctgtggcaatcccaaccctttcaaagtttatcctgcagacgttgcatacaagtgtagtatacgataggtctagagcaatgttgttagcagcgtttattcataaacagcaaatgtgtccatcaataggtactagttaaataaattgtggtgcatagcaggtgataccagatagccaaagaacgggtgatgcaactatatgagtgttgacacagaaagttctgcaagagatattaggaagccataaaatcaagtgcctatcagtgtgtatggtaggaccttgtcagataaacagaaaccaatcaacacctatcaatgcctctctgaaaaggccctccttgcactgggtaacagtggttccctgctgtggagaaacccacactgctggcacaaagggacccaccctctcagctgtggctgtgaaagaggaaaggctcttatcagagagaggcattttttggccaaaattgatgcttaaggagatggttgtgttatttgggcacacagggcacataggcacatgtgttgcatgtagccaggaagtctgtgtggggtcacagggccccctgggcccagggagcaggaccagctgtggcccacctgcaggttccatgtctgcttcacatattccctgatgaggttttccttcaaatcctcaaagggcccagtcttgggctgcaccccttggggccggttgaagggcttcttgaggaggcagaccaggccatcagactcctgggagtggtagtggcagaggtcggcggggctggcatgggtcctgccaccggcgatggcgtaggtgccattcagctcccgctcgatggtgtagtggtgtgccttcctcccgtgggccacggacagggcgaagccacccaggtagttgcggctctggcgcagcaaataaagcccatcactcatgcccccctggaccaggtaatcttctgcctcctcccgggtgatgttgccgaaaaagaagggcaggtggttggcgctgtcagccatgccgctgctggccatgcttcaggggccggagggcacacacctgcgcaggtgtccacctgggcaagacagagacagagaactttggtgaggaccccacgtggcagggaacgtttgctaaaaccactcaaaccctttcaaagtggagacaaaccctcccatctctgaacaaaggcacttccctctttggccctcccaacacacagttgtctttctgttcacatcatcattacagttttcagcatgccttctaactaagctaaaatcagagcatttgatggaagtgaccaaattaaataattcttttttggggggagtggggaaagacaaagaattctaaaaataaacataccgcaaagagaagcaaacagaagggctattgcaaaacaggactcttgggctgaccctcagggtcccagcagcatacaggaggcagaatctacatgagaacaaaccaactgctcctcctgagtccagacaatgttagagaagccttgctcctcatcacagtgatattaccaaggaggacgctaccaccacctcacccacctgagctgcgagacgctgcctcgagcagtcagtcacacgctggtgctgagccccagaggtgaagtgaggccacgttgagggcccacacggaactgtgacttgtggtcaccataaggccttcccacctccagcccggggctatgatagcaacaagccactgcctgagacatgaagagtgacaccctccctggctcccgaggcctggggcccataggctgtcttctccccgcttctccagaccacttcctgggcaacgccacttcccatctgcagggcccgtgctaaagagatagtgccggttcccagcccacgaggacatctgacacaggagagacactgcttgcagtaaataaatacatttcagaagcaaaaagaaaggcggccaatgcatatttaacatggagagtattccctctcaatcatggttgtaaactagaaggatacatattgccagccccaaaagtatccaaggaggcacattttaaccaaaaggggctggtcgtgaatggaaaattatctacatgactccatccatttatccagggagcaaagcgcatgtccctcatggtacacacacacacacacacacacacacacacacacacacactctctccataccacatgcacactacatgcatgccacacacactatgaacacatgccacacctgcactacacacacaccatgtactacatgcacactatgcacatcacacacaccaaacacacaaactacatacataccacacacacgaaacacactacacacatcacatgctacactacatacatgctacacacacaaaacagacatgaaacacaccactgcatgcacacaacacacatcacacacactaccccacacacatacacatacacacaaactacatacacaccacacacatgaaacacaccgcacacaccaaattctacgttacatacacacaaaacacacatgaaacacaccacatgactacatgcgcactacacacatcacatacggtacaccacacaccacacacatcacatacactacaccacacacacacactccataccacatggacactacatgcatgccacacacactacgaacacatgccacagctgcactacacacacaccatgcactacacgcacactatgcacatcacacacacaccacacacacaaactacatacacaccacacacacaacacactacaaacaacacacactgcacacacaacacaaattacatacataccacatacaacacactacacacactacacacaccatgtactacatggacactacacacatcacacacaccaactacacgtacaccacacacacaacacactacacatatcacacactgcacacacaacacacaaaaactacatacactccacatacaacacactacacacaccacacacactacacacaccatgtactacacggacactacccacatcacacacaccacagactacatacacactacacacacaacacacataacacactgcacacacaacacacaaactacatacacaccacatacaacacactacacacataacacactacacacaccatgtactacacacatcacatacaccacacacacaaaatacatacacaccacacacagtacacactacacacatcacacatactacacacatatcacacacaaactacatacacattacacacataacacagtacacacccacacacactgcaaacacaccacacacacaaactacatacacacgacacacaacacactacatgcaacacacatactacacactacacataaaaacacacacaaaccacaccacatcactacatgcacactacacacatcacacacactgcacacacaccacacacaaactacatacatgccacacacacaccatagtacacacaactaacactacactacatacacactacacacacaaaacacacacatgaagcacaccacaccacagatcctgcaccacgatgatgtgaagcggcttcttctcaacatgcactatcctacaaggggctataaaatgtaagagcatcagcctgacacaggcgacagagttttccccagacggtgtctatccacaagtcagtactcctgggcgagcccctaatgaggcatgggttttattataatttgagggtattaatcatcatttcctggcttgcctctcacagcagttgactatcaatgacttttctttgtccaacaagtttctaaaaattcatctcttagcaaggtgtttttgttttttaaagtatatctacatttacttttgagtctaagaatgctgttaacagaaagacatctctggaaacacagtgtgctgatgagtctcttggaagaaatacttctctttggactgctttcccctttctacagttttttttttttttttttttttagaagagacggggtttcaccgcattagccaggatggtcgcgatctcctgacctcatgatctgcccgccttggccgggcgcggtggctcacgcctgcattctacaatgcttttgttgcaggccagccactgcccccagcctgcttttcccccactccacccttttcctgcagtgggtcttctcgggcctccaacctcatttccattgtttcccctgcagcccagcacgtctcatacttccacgtggcctgggggctctgacacacccagggcctgagacgctgctgctcctgcaatcctggtgatgcggatgctgggttctgatgccacctgagaccaggttctccatcttctctgccttccctgcccaggcggtgtcccagccaggaacccaggagtcctccgcaggacttgcgttctctaaggttcgttttccaggcgcccttggtgcatgttccttactgcccatatccatgaccactgcttggcgtaaccctgtcctttccactgctgcccttcactcctcaccttctgccctcctgcttcctgacgcctccctctccagctgcccggtcctccctcaaagcgcacatcagcccttcctgcctattccaacatgcccagtccacagaccacactggactgcaccgggatgctgtggctttcccttcttgttctcaccacgtgtgctttctgctgaggcgtgcagctcttcctcccagccatctcagtcatccttacagacccagctcaaatacccctgtcactgtgtacctggccccgatgcttgtgtcccctctgcagggcccaggttactttttatgtagttgcagaacagcagactgcaccatcagctcaaactgagacagtaactttgtaggaacaaaattttaaataaaatgagagcaaatactttttaattcatataaatcttaacatagctactattttaaaaattcattggcttgtcactaatcattacatcggtgctggcacttgggcatgaatcccatattgaagtgaatggaaaggaagtgagacaggctgtggtcgggtcttggggagcatctgcagacccggagcaacctccaggcacacgccagggacactctgtgtggctttgatggtgcattgcagatatgttcgcaagcaggtggcagaagaatgtgctgcactcagtgtcagcaccgatgtggctgatggcccttttctggccatgtgacttcctgtgccggagttgacctgggtatgttggtggtgatggtttgggcagaatcactggttcactgcaaggacagcttatggcacatttttgggctacttaattgggggaataaacaatgtccatggtgttcctgtgcataccttctcaggactggcacccaccggcacccacccggggccttgtcctggtctccaacctcctctttctcaggccaccttggcaggaaatggccatctccattccagtcactgcccacagtggcccaggctgctgttctcagctccacttttcagatatcagctttcagtcagtatggcaaatccagagagtctcacttttcacccagcgtagtcttggccacggctgtggcatctctgccacccccaccaactgagacagggacggagcccgtgactttcccctgcaggcattcctcctgcacacacagactcagtccttcccgcctgatgcttttgccaactcacaatgcttaactctgactacaggaacagctcatggctcaaattctctttagcattcccagggatcattttcttccaaatagtgtttagaacttgctccctattttttcttaattcaacattcccagttatttttttccatgtgtgacactacttcattccaaagcacgaaactgagaaacaaaccaggccacttagctcctccttaactccacctgtacccctcagcctgctgggtctggcacctcagtgaacacctgggcaggtagtggttcagcaaggagggttttcaggtgtctggtgagctcctgaaaacactgcaaatcccttgctcttttgagaccttttttgtgacacaagttaaatgtgcacttagttgtagaaaaatgttttttgacatgaaataatcttctgtaatgtcctgggccgcatacctcccttccctgcctaatttttctctgcagcacatctccataaggcagcagccctttaaatcatgattcactgttgaatttgagtattgtcttgttcttcccaccagagggccagctctgggaggtgagaataggatgaccttgttcactgccatatcaccatgcctggaacagctcctagtgcagaataagtcatcaaaaatatttgttggttaatgggtatttatttctctccactgagctcctgatctgcatgtctgcttatctgacgtccccccttggatgtgtaacagacaagttgacctccacatactccagatgaggcttttgactcctcctgccactccctcagcaaatctcttcctccctcagtctctcctaattgaggaaatgacattgagcaccacagttgctgaggatgagaccctggctgctttcaggagtcttccctctcaccaagtcagaaaggaatgtgctttctaccagaagcattggccactcacagtgatgcagggaagccatgagcttgtgcaggagctgagctccatctgatgcagtcacagggatggagaatcttgaagcaggttagatgagctggtctccaggtcctctgagtagcttttctttaaaatatattcccaagccatcatgtctccccatagctcctgaggctgccctcgtggaagccaccgccatctctcaggtattggaagtctcacctggtccttcctttccttactgacaattccctaccctgaaggtggagtgaggctcacaaggaacctctccatccacatcacatcgcaaatcttcattgctcctccacaaggctctccttgaccaggcccgagacctgcaacctcaccttgctcactatctccaccacactgtgcttctgcctccaggttgaggcctctcctgcctcctgcttggcttcctccttctcaggcctttactcagagagttgcatcatgatgatccagtctcaggtgctgcttcggcctaccttggccacccccgcacatagttaacttctcaaaagcatctattacctttgtagcatcaacacaaacctgccctttccctaaaatgtgagccccaaaggtctggagatttcactgccttgctcaggcttcagggtttaaccagaggctggcaaaatcctgcttgatggaaacatgttgctctttgctttttaggatttccacagtgaatatacaactgacccttgaacaatgtggggatgctgaccacccaccctgtagtaaaaattcatgtgtaacttttgactcccccaaaacttaactaatagtctactgttgaccagaaggcttacctataacataaataactgattaacacatattttgcatgttatatgtatcatatactatattcttatagtgaggtaagctagagaagaaaatgtcattaagaaaatcataaggaatagaatatatgtttacaatactgtactgtatttatcaataccataaatttactgtcatctgtttacaagatgactcatccatctgaaatggcaggcaaccatggctacagtcctccatctacaatcctcatcaagcaattcagctttttcttataatgtcatgacttcttgggagcacttccagcctcactgtgacccttcacatgggacccatggtgttattcaggttgtacggtattgcactaaacattatgaaaaatacttgagaactgcaagagatcacttattaaagatcactttttactgcaatatgcaatttactggagagatgaactgctcacacagagatgatgagcatcacacagtgatttaggcaggtacttgcaactctcgagctcatcacaatagcaacaggaagtggctatgaaattattacagcagtacagtgtgtactgcagttaattttatgcaattatgatttaatactgcatctttatatttatttacattttcctcgactgtgaatggcatataagtatttatgtgtaagttttgataaattttaattttaataatagagttgtacacattttatggtagtaaatgaaaaaatagactacatatattttgtgcattcaatatacacttaactttttcttaactttttttttttttttttgagatgaagtctcgctctgttgcccaggctggagtgcagtggcacaatctcggctcactgcaagctccgcctccccagttcacgctgttctcctgcctcagcctcccaagtagctgggattacaggtgcccaccaccacgcctggctaacttttgtatgtttagtagagacggggtttcaccttgttagccaggatgatctcgatctcctgacctcgtgatctgccctcctcagcctcccaaagtgctgggattagaggcgtgagccacagcgcccggccaacattttttatatttctgggctatggagttcatctgcaagtttttaaaattgtcaaaaaccttcaaaacttttttccaatatttttgttgaaaaaaaatccgcatataagtgaacccacatggttcaaacctgtaacgttcaagggtcaaaattgtatgttgcttttgtaataaaaatgctaaacatgcaattgctgtgtgtccagatggaggctaacagggccagaatcagagaaccctggcaactaatctgcgagatgctccagccctgtggctgcttcagatggagcttggttcctacataagctcctggcctcttaagggaagggaactcactccaatgtgtgccgatgcttctgttggaaaacactttcttatctgattccccatctctccttccccatctctcctcctccatttcccgtcttccaactgtgcacaggacaaagagaacacagccagttctgcttccccaaaacaacctgcaaatgcttgctcttggcagccactccaagtcaatgcattcttcctgccttgacattatttcaagacctctcactcattttgtccaaacaatttcatatcacccaagctcctcttaaaagtgcaccggccccagtgacgctgccaagatttcctgggcccgtgtccagctgtccatgaatgcagctatgggtggccccatccatccaacatctccgctgggcttctggagaatgaacagcttcccttttcaaaagcatgtggtcaaaacacatcccccacactcaatttacaaattaagatggttgcctttaccctgttccccctccttatgatggtcccacccatttccatctggcaccattcatcacattagctcggggttactcaaccttggcactcttgacatttgggctggatccttctctgttatgtgtgtagggtcgggggctgtctcatctagtacagactattgagcagcatccctggcctctccccactagatgccagtagcaccccattccccaatcatgacagccaaacatcgtctccagatattgccaagtgttccctaagggtaacttacccctgactggaaaccactgtgtcagctgttgtggacacaaatctgatgtgcccattttattgctctagcccaggggtgtccaatcttttggcttccctgggccacactgataaaagaaggattgtcttgggccacatataaaatatactaatactaatgatagctgatgaactacagaaaagaagggaaagaaatctcataatgttctaagaaagcttacaaattttagttgggccacattcatagctatcctggaccacatgtggcctatgggtcatgggttggataagcttgttctagcctttttaccaataaattagatgaacaaatattcccctatttaatttgttaacatcattgccaatgaacaaaagacaaggctggaaaggaatggtaccccgtggaggtggttccactgggccagagagcaggaaacccagggacacagaggtgagaatcgggaacgctggcgacccggcccagctttgtgtgacctgggcactatagcaatagagttcttcactggtgaaaggggatgacagtataccaaagccactgtaactaatttcagtcatgagtggggagtgtggaggggtgcccagggcaactggaccctctcaagtgggaactttgaatagaagagggaaggataagtcatggtgagatgaaggaaaaagcacgggcagccagacccacacttcataagaaggcatgcatgtgtgtgcatgtgtgtgcacacatgtgtgtgcatgaggctgggagacagacggacatgcccacccccacctgaagatggtggaaagtcagtgagggcttggactgaaccaaagacaatgcttccttacctcaaaatcctccctagtgccagtcaggcttcaccttgcacgtgatacaccatgaggagttaaatctagaacggagtcagatttattctacaggctttgattctttctgccccacaccaaagaagccctgccagccaccctcctggagcctgcagaaatggatgagcccatcatatcccactagcatcctcatgtcttccatgtgttttatttaaattatactgtatccttttgcacttactggcatgtttcaatcttctcttccaactagacttccatagtccatttcccctatgccaggactaaagctgactatacaacctttgccctttaaaatgcatttagttgggaaactatcatttgtgtagttctaccttatcaggcagcaactttatagatgaagagcaatagatccatgcttgccaccataagtacaatgtttcagataccctttcagctaattaagaaatgatgtttctagggcagtctgactggaagattaggcacagatgctcacacctgagcaagcagctgaacaagctgtccagagcccattcttctggcaggggaaaatttcatcccctacagaggaacagccagcatgaatgccaacatgatgaaggggggctgagctctataggcccacctgacactaacactcccagctccctgtcccaccttagagttttagttctgtttttttgtctatattccccaaagccactagaatagacactccattagtgtaagtacgtttacattttgttctctactgcctggaacagaggctactttaagtatgggtcttcagtcttcaaattttgtttgagagttaaaatgtatacatggcaggcagcctccaagatggtgcccagtgatcctcacttcctggtactcccatcccttgcacacagagtggctgactgcagagtgacaatgttgggtctctgaagctagctcatgaaagcccttaacacttttcctcagcttttggattgctcactctggggaaaccagatgcctcattggaaagatgctcaagtagctctttggggaggctcatgtggtaaggaactgaggcctctagccaatagccagcagtaagtgaccagccgtatgagcagccaccttggaatagtatcttccagcctctatcaagccttcagatgagactgtagccctggcccacacctgactacaaccctacagagggcctgagcctacccagctatctcaaatgcttggcccacagaaattatgagcaataataagtaattattgttgttttaaaccactaagtttagagtgatctgttatgtagcaacagataactgatatagcatgtgcaatggagttgggcgagagaagcaacagtgcttaatggatatttaagtaaataaatatttgaatgaattgttgacaaaaaaggctggtgagtgtatgagctaggttctaggagctgggctctggcagaatcagaagaagactttctggtattgaagaggtacgtggagctaaaatagaggttaggaaggaaggagctgagcccagtgtgtgcttctggaagctgcctgcctcaccctggcttctttcatgtccacgtttacctgtagaaaatggttagaggactagctgcccaaaccctgcaagggccacattatctgagcctggcacttagagattatgggaaccaggatcaaaggcagaggccaaagttctgattaatttattatcactagtaacattttaactaataaatcttcatagtgtcatttctttcttttctttctcctctctccatttcatcgatatcatacttctggttctgttctctttccatcttatgcatgaaacaaaatacagttgcttcttgttattcacaatagttatgctctataaaatcaccatgaaagctgaatttgcaaatcctgaacagttgctcctggggaaatatggtgttaggtttttgtgatcctctggttacaacttttttgtcaatcaatcaatacagaaccttgttttatgtgtatttctatttaaagatatttatttcatatatattgttgattcattaaccttgaactcatggtcaacagcacaataactcatgcctgaaagtagcttccctaacacacgtattttctctgtaaagcacatcacaaccttcttgcacttagagacaccagacagtaagtactttagcattgtgtttggggccatttttaaatagcaaaatcaccccagaaaagcacaaaaatgcaaaaaccatggactaaatgggccaagagaaaagaaaatgtgtttataagagctaaaacaagaaagcagagtgtcaccttgtgcgacctcaacgtatgtgttgggtgacttaaatttttcactgctttgtgcacgtcacaaatgactgcaaaagtgctgtgagtattgattttggggttgcaaacagatttaaatgaatagatgaatgcggagatatggaatccatgaatcatgaggactgataataagtaatttcccttccgtctccccaaccttccctgaaaagacccaacctcatccataaagatatataaatttaccttggatgttttgggaaaatagttatctctatgtaagactgtgttcttaaatatattactcctatctcataaatctgtgttcatttcaggattttctagcttggcattgaaccagaagaggtagcctatgtctctgtatccctttttattaacccatctgtcctagttatcaaggggcctcagccctgagattccaggcttctgcttttcttgagacccactgaagcatggctccggcaggtgctgcctcctcccctccagccccctcaacttcctgtagttcacatttccagcagtccttagcgattgaaggtgtctcactttcacatccctgggccattagagccctcctatcatacagagacagtgggggaaataagtggttctctgggaaaagatcacctgcaaacaattgttgccaaatccataccatttaagggaacaaaaatcagcatagtgcagaaagatatccaggcttatcacgctcaaaccacacagccccctcaatgcaaagcagccctgttaagatgtgcctaggaatttcctctgcagcttgaagctgagaaaattgtcaagacttgggtgaaaggaaacttcatctgtgggttaattttcataagaaagaggaggccgggtgtggtggctcacgcttgtaatcccagcactttgggaggctgaggcgggtggatcacaaggtcaggagattgagaccatcctggctaacagggtgaaaccccgtctctactaaaaatacaaaaaattagccaggcgtggtggtgggcgcctgtagtcccagctacttgggaggctgaggcaggagaatggcatgaacctgggaggcggagtttgcagtgagcagaaatcatgccactgcactccagcctgggcgacagagcgagactccatctcaaaaaaaaaaaaaaaaaaaaaagaggaatgagtccaaccagagggagaattgatcttgctggtttggtcagggactggctgattaattacagagaaatgaccaaggaagaggtgatgtgatgggaccaccccacccagcaccaggctctgcaaacaagcatgtttgactcatctgcaaagggctgggggcactgccttgtgcggcagaatcccactgtacaaaagaaaacatgtggacacagacctgtggcctcaacactgaggaacagaaccccagctgcagggcctgagttggccttgcatccactccactggcttcgtcagtaggtatcacttgccctccacggcgccatcctgaggcctgcctgtgcatcacactgcacagggtgcctggtctccaaggcacagccttacattgtgcacattctgctgagcggttgactctcccatatttgcaggcatacatgggggacttcttagtatatagagatacacaattcagaaacacaaagtgaagctaaggatggtagcatgaggcatgatttttactaatgtttagaaatagagggatattgaaatacttgaaaacattatccaaaccttcaacaccaaattctcttgctgtgccttcagaacttaaaagattgaaagtgcatcaagtaaaggctgatctatctcaaccaacacatagacattttcaagctctgcaaaagacactcagaaatctcttctctatgcccaccttgccataattaacacagaaaacagatattacgctttggtgttaacattatgttaatataaatgttaactgtgtagttataaataaacaaccagcccatctggtgcatttaatttacaatctaactgattgattcattcaatatgcttgttgagcatctatcacgtgcaagtcattatgtcaggcaccatgtgagagaaaaatgaacctcctgcctccctgacaacaggtaggcagaaatggctcacgaaagtaagagaataaggatctggtccgagagttccactttcatcctggggactgcgtgatttccaggttctctactatcctcacgtcttcttgcctctaagtgggactggccaaagccacctgcagattctagttcttggcaggactctggctcatgaaagctcacatgtccggttcttcctgagtgtggtcttcagggcaccccaccctcaggctcccttctggaaagcagggttctgggcccacctcagacccagcaaatagggcatacggacaagaagggtaaattttaaacagcttcctaggtgatttttttttttttttgagacggagtcttattctgtcaccccagctggagtgcaatggcacgatctccactcactgcaacgtctgcctcctgggttcaagcaattctcctgcctcagcctcctgagtagctgggactacagcgcacaccaccacacccagctaattttttgtatttttagtagagacagggtttcactatgttggccaggctggtgtcaaactcctgacctcatgatccgcccacctcggcatcccaaagtgttgggattacaggcgtgagcctctgcgcctggcctgcttcccaggtgatttttaagcactctaatgtctgagaacctctgctataatctaatattgccctattcaagtgctacagtgtgacagggaggcaagttgaccacgttcagtgtgagcgaaagcaagttgccacttgccacgggtggggaagggagccagggaggacagtcaagtcaccgtgctgtgctggtgaccgggccaggctgcaggctcaacctgggagacatctctgcagttcttctccaccaggaagaagtacatgcctcatcatacaggtgtgctcagagaagggggaagggacgcacacgcaacgcacacacaattggtaattaaaaagagagctagcttttgtgaataattaacagaacactgggttgcaaccaaaattgccacttagcaatgtcccttgcatgctcttttgagcagaagaggacagggtggggttgcagccagcggtgtggggcgcatattgaccctgagtggggccaaggatgtctccccagtgaactgcaccatctaccatgtcccagggccacctcatcactcactcttctctggggaaaaacacaaacaaccaacaagatgctagaaaaaagaactcacgttgaatatgcctgatagatcttactatattgcttttatctgggcaaaccacatatggatgatgagaagggcagcgcagttgcaggctttccttgatcctgccctggtacccatcccaagatcctttcctactcagctgtgaaggcctgggcggggcgggggggggggcgggggtgaggccacagcagactgcaatgacaacagccggcagacctaacatctcttgtctgtgccttagtgccttgctgaagtttcccgctttcaggctctattttacttttccatcactaccttatgagcataatctttatggggatcctgcagctgctagagaaaccaaaacacctgacttaagcaaaaaggacacagtaaatgtggattaagaaatatctagagttttactgaatgtctatttaaaaaaaatcgctagcattctttttcctagccagttaaaaaataattgtgggtgactcaggactgcaagatattacaggagcttatgatggtctcctgagattttataattgtctttcataaacctgagacataaatatactcaatgcttaaagcaaagtggcataggttataggaaggagagaaggatgctttagctgcatcataactgcaggcaagacaagatggcaaaccgctaaaccttccagctcaagatggacatgtgctcagtggaagaatgttagcggcagaggagaggaaacgcagatgcaggcatgaaacctaagtatccctcctacagacacccacagatgcgcagagcctgaggttagggtttctaaatatgcttgattcccacaaatttgacctacctccctttcctggattcaaacgcagatctggaatcccaggcgctgggcagtatagaatgtgggaagggaagaagcacacaaatctgagaggagtatcttaaaaggaaaacagctgaaacagagagaaagcacaagacaggcatcaacaagccagagtgcttcctgctgctggacgatgtctgtaattagggaaatgggcttttcctcaaagtgtcagcatgcaaaacaaaccagaaagcagaagtgtgagatccccagcagcacggggcctcttttaattgcacattcaaaatgaagtaatgctctgagacatggatccctccagaacacacaccagttgaggagggagtcagtggacagggctgtgccatttagtgcttagccagcctggaaatgccctttcccaagtgtttttaccaaaaatgaacttggtcttgaattgctggaatgggtatagcgaggttttcctgattgttttatgtttttttaaaaagtcctacatcataacatgtatcaaattcaaccagaagattgaaccaaataggaagagcatccttgaaaagatcttaatggagacctcaagatgctaattgccagccaggagactgaaaaagtcaagcagagatggtcttaatggcggaaaggccaatgtgtagggcagaggaaagaagggtgccagctctctctgtccctgttcccaggcctcctggtcagacagctgctcatggtgctagcaacagatgcaactttacagagcacctctgaccagctccctcagggtacttttcaagcatctactaacattcccttactctgtgaagcaagcagctttttaatttcccactgcagtctgtgacatcctccacactcaagaagggccagaagctcagccagggcccactccacaaaaggccgtgaaacatccctggaaacgcaagataaaaaggaaccctctccagagctgtagaagctggaaggagtcatgttgatgagtttactggggtggggttaggagcctcgcgagggaagtgttcagaaacacaacagtaggcaatctgcacctgcaccccaaacttgtgaaaatgacagcttcatgaaaaacaagttctcattttatagaagataaacttcagccacagaagaggttggctgtacatctttagtgctggccagaatggccatgatgatgaaggtgatgaggataatgcaaaacagctattccatgagtacttgactcaaaggttatcaactgatgtgcacaacatccctaatggtagatactattgttatcctcaattcacagacctggtcatcgagcctcaggagggtcaactggcttgctgaagaacacacagtatgtggtggagccaatatttgaagcctgcctcttctcttagctaccatcttcaggtggcagtgcaaaggccctcatagtcaacccatccaaatgtaagcttggggctttcctgcctaacttggagctccttcttgttccctggagctgggttctcaatgtgcgtctctggaccagcaatgtcagcatcaccaggaaacatggaggatatgaaaattcttagggttccaccctgacctgccaaatcagaaactctggggtgaagctctaggttttgtattttaaaggctcaagtttgagaaccttggcccaagagctccatccatttatgaagatgaaaatccaagctctcttagatcattcccttctctacactgctgaaagtcaaccccttgccaatccctcccatctcacgtctcagcctcccacacatgcctacttgtctccaaaaccacataacatccttttcctccacatctcttttgagtagctctggctgtcaatgcccccaccttgctcccttcctacatgttctaagctgtggcccttttctctgctaaaaatcctccactgtccaggctaccctttgagctcaggataaacatgtccctgtccccacagtcaaaactaacatgctttccttttgtaccactgaccactgttttgacttaatttacctttactttctagcatgtgaatttttgatgaatgtctgtttgtcccataagggcagaaattgtatctgtttctagtaagacttgaaattgagtagtgtgagtcctccaactttgtcctttttagtgggtattgtgttgggtattctagatcttttaccttcccaagtaaagttcagaatcatttcatcattagctacaaaacagcttgctgggattttgattgggattgggttgaatctacagatcaagcttggcagaatgaacattttaacaacattgagtcttccaatgtacgaacatggactacttttccatttacttacatcttctttgattcttccatcattattttgtagttttctgcatacagatcctgtacatattttgttagatttatacctaagtattttcttgtgtttttttttttttgtctttttggtgctattatacatggtaattattcttatttcaaatttcaatagtttactactggtatataggaaagcaaccgacttttgtatattgatctagcatcctgtagactcacttattggttattagagttgttttatggattctttgaagttctccatatggacatgcatattatctgtgaaaaaagatgtcttatttcttcttttctgatctgtataagttttgttttgttttcttgcactagctagggctcccagtaggatgttgaacagagtggtaagagaggacagtcttaccttgttttcaatatcagagggacagtgttcagtctctcaccattaagtatgatgttacctgtaggtttttttttttaatgctctttatcaagttacaaaagttttcctctattcctagtttaagattttttttttgacatgaaagagtgttttgagtttgtcaaatgccctttctgcctccattaacatggtcatatgatttttcttctctagcccattgatgtgatgtatcacattaatttattttcaaatgttgaacctgttttgcatacctggaataaattccacttggctgtggtacatagctcttttcatacgttgttgggtttgattttctaacattttgttgagggtttttgtatatataagtaatattgctttgttttcttgtaatgccttaactggttttggtattacgtgaaatctgaactcataaaatgaattagaaactgtttcctccatttctattttctggaagagattatggaaaactggtattctttctttcttaagtgtttgacagaattcactagtggacccatctgggcctgatgatttctgttttaaaggttatattaatttaaattttaaagatatagggctattcaggctacctatttcttctgtaagttttagtagtttgtgtcactcaagcattagtttatttcacctaagttaccacatttgtgagtacagagttgttcatgatcttcctttatcatctttttatatccattagatcaacagttatgacctttccttcatttctgatattggtaaattgcatcttctacatttttttcttttttttttcttggttaaaggtttatcaatttggttgatgatttcaaagaaccaacattggttttattgacttttctctactgttttcctgtttttaatttcaatgatttctgctttcattttaattatttcttttcttttgcttggtttaggcctaatttgctcttctttctgtagtttcttaaaagtagaatcacaagtaattttctttatatattttttacctaatgtgtgcacttagttctataaatttctctataagcactgcttttgctacattccaaaatttttgataaattatatttttatttttatgcacttcaaaatatttttttagattttggagacttcttcttggaaacataggttatatagaagtctgttgtttgatttccagatatttgggaaatttcccaaaacctccatctttttgttgttgatatctagtttaattatactgtgttctgagaacataattggtatgacgtttagtctttcaaatgtgttaacatgttttccaagaatgtgctctatcttggtgaatattccaagtgagcttgagaagaatgtgtatttttctgttgttgaatggaatattttataaatgtcaattagatcaagttgagtgacagtactgcttaggtcatttttatcctatctatttggtctatcaacttttgtgagaaagagattaaaatctctaactataagacaggatttgtctacttctcctttcagtcttaccagtgtttgtcttgcatattttgatgctctgttgttatgcacatacacatttaggattgttatgtcttcttggatattcgacccctttaccattctgtaacaatttccttgaagcgctgacccctgttgactatgagttttttgtcctttaagtgataaagtgatgagggtgctggaacttgaggaattcccttgggaattcccagctgagacaaggctcttgcaaagtgttttcccttggagagtaaccattgtcatggagaaagcctaggggtattttacagttatcactcttccctcccatgccagggccatgaggagctctttctcagatcttcacaataagaacctagtgaggcttgtattaatcatgcctttctatttcttttattttctggtagctatgtctacagtgttattcaaagagatgattagctccaggtgtggacctcaggggccttgtacctgagctgtgtggactgcaagtaagactcccactgaaggcaatgcttgaagctgctgtgcagtgaggcagagctttctgtctgatagcctctgagtgagcctgtgcccaatatcacctggactcatcctgtgggcctaaatattgggacccaggaggaccgcctggtggatgtgcactatactaaatcatcacctatctccagcatccgcaggtgcaagtaaatctgccatacaatcggtctctgctaatgagaaagagacattatattttagaaatattgactatgaaaaattattctttcataagaaaagtgtgtgataattagcagattctcattttgagaattcaatgggcttgctactaagtttaaacgaaatatcacattgatgagactgcttttaatcctgaaggctgtgatctgtctacttctggactttttttgcaatgcccttttggtaccaaaacagtgccagtcacatcacaggagcccaagaaaaatctgctgacttaattaactaatataaaatgtaaggcaaagagactttctctgtgttataaaacagttcaactgtttcgaaaacatatctcttacaaaaacagtaaaatttaacttgcttttaaaaattatttccttgctttgtaaaagaagtagaatatagtttattctcattatttcaggttatacattccacaaagtcacccccaaaactgaattagcaagtagtagcccatcgcttctcaggggttatgtgcctgagagcctgccgtcaccatattttcatcaactgatcaatgcatcacttgttttatgtgtttctgtgtaaaggcaccttatttcatatctattgttgatgcactaccattggactcacggccgacagcactaactatgactcatgcctgacagaggcttctctaacccacatattttccctgtaaggcacagcacagccttcttacacctagggacaccagatagcacttcagctgggggtactctaaacagcaaagtcaccacaatttgaaaaaaggaacaaaaatgcaaaaaatacggcactaagtagactggggaaaaagacacttacttataatatgaggtgaaaggaggagttggagcgtctggaatatgcatgtggctaaaattttgtgccactctgtgatatggtttggctgtgtcctcacccaaatctcaacttgaattgtatctcccagaattcccacatgttgtgagagggacccacggggaggtaattgaattactggggccagtctttcccatgctattctcatggtagtgaataagtctcatgagatctaatgggtttatcaggggtttccacttttgcttcttcctcattttctcttgctgctgccatataagaagtgcctttcacctccctccatgattctggggcctcccagccatgtggaactgtctctttttcttcccagtcttagatatgtctttatcagcaatgtgaaaataaacaaatacagtaaattggtaccagaagagtggggtgttgctgaaaagatactccaaaatgtggaagtgactttggaactgggtaacaggcagaggctggaacagtttggagggttcagaagaagacaggaaaatgtgggaaagtttggaacctcctagagacttgttgaatggttttgacaaaaatgctaataacgatattaacaataaggtccaggctgaggcagtctcagatggagatgagaaacttgttaggaactggagtaaaggtgactcttgttatgttttagcaaagagattggtagcattttgcccctgccctagagatctgtgaaactttgaacttgagagcgatgatttagggtatctggcagaagaaatttctaagcaggcaaagcattcaagaggtgacttggggactgttaaagtcattcagttttattaaaaaaaaaaaaagagcataaaagtttggaaaatttgcagcctgactatgtaatagaaaagaaatatccattttctggggagaaattcaactcagctgcagaaatttgcataagtagcaatgagcctaatgttaatccccaagaccatggggaagatgtctccaggccatgtcagagacctccacagcagtccctcctatcacagacctggaggcccaggaggaaaaagtggtttcgtggcctgggcccagggtcctcatgcagtgtgcagcctagggacttggtgccctgtgtcccagctgctccagctgtggctgaaaggggccaccgtagagctcaggctgtggcttcagagggtgaaagccccaagctttggcagcttccacgtggtgttgagcctgcgagtgcacagaagtcaagaattgaggtttgggaacctctgcctagacttcagaagatgtatgaaaatgcctggatgaccaggcaaaagttcgctgcaggggcagggccctcatggataacctctgctaggacagcacagaagggaaatgtggggtcacagctcccacacagagtccctactggggcactgcctagtggagccgtgagtagagggtcaccatcctacagacctcagaatggtagatccactgacagcttgcaccatgtgcctggaaaagccacagacactcaatgccaacctgtgaaagcagccatgagggaggctgtacactgcaaagccacagggatgaagctgtccaagaccatgggaacccatctcttgcatcaatgggacctggctgtgtgacctggagtcaaaggagatcatcttggagcttaaaaattgactgcactgctggatttcagcttgcattggccctgtaacctctttgttttggacaatttctcccagttggaatgggtgtatttacccaatacctgtacccccattgtatctaggaagtaactagcttgcttttgattttacaggctcagagatggaagggacttgccttgtctcagatgaaacttggactgtggacttttgggttaatgctgaaatgagttaagactttgggggactattgggaaggcatgattggttttgaaatttgaggacatgagatttgaaggggccaggggtgggtgatatgatttggctgtgtccccacccaaatctcaacttgaattgtacctcccagaattcccacatgttatgggagggacccaaggaaggggggtaattgaatcatgggggccagtcttttccatgctattcttgtaatagtgattaagtcttacaagatctcatggatttatcaggggtttcctcttctgcttcttcctcattttctcttgctgccaccatgtaagaagtgcctttcacctcctgccatgattctgaggcctccccagccatgtggaactgtaattccaattaaacctctttttcttcccagtcttgggcatgtctttatcagcagtgggaaaatgaactaatacactgtgtgtatgacctcaaatggtcttgaaagcatcatggttattgatttggggattacagataaatgactgtgattgtgagtaggcaaattcacaaattcagaagccatgaatactgaggatcaaccatatattatctcacataagactgctatgggtgactcacattcattctttatccattttgagtgacttctaagatattcaccaagggcctcagtggtcacaaacaagctggatgggaaagtacaaattactgtaaaaatcaatacacagatactagtacttggaaaattataatatcagtctcagctcctgatagccatatctccctgtattcatttggttttctaacaaaatgtttcctgctactctcaaaaacataggttttatttacatataccaaaaatcagctgatagcatgagaaaaatctgcctggtttcctattagaggggttgatatttgcagtcgccaacctgcacagctgagccagcataattcctgcagggtagagaaggccatgaagcctaaatcaggggcaccagaggggcctgagccaggcctgctgctcaccagctagccagccttgagcagattactctccacttcctcatccataaaaggttatagcttccactttattgggactgttcttttaggaaaaataaaggcataaatggtaaaataacaacatttattaatttgggtggtactgcactgttctgtattttataatttttttcacaaagaaaaaccctatggttgctgtcactaataaatgagattatgcatgagcagagcctgatgctgggctcccatgcttccttacgatctgaccgtaaacaagtcaagtgcagggaagcatctcagctgctgcgacagcccccatacctcaccctgctcctgacacgtgggaggcgccccataactcaatgtgctgaacggatcaaagccaacaaaatggcctggttgaccatcagagaggctggtggaagctaagagtgccccaggaacttttttggtcattctgaagttgtttcctgcttatttgttgatttttaaccattggtttcaatgccacatactctaagtcactctgtaagataaacatcaaaatatcagattgcttgggtgttggcagagatactgccccctcctctctgaaatgaccctgcaacaagaaccagataaagaaataaaatggaaccagtgggcaccccgatcctgagcaataacatgccacaagcggagcccaatgcagctatgtttgccctgggatcatgaagacccttagtggggactggctgctgtagacttcagacaaggcctgcagagtggaaggatatacacagcaatggaaagccaaccatttcttagagtgttgaagagaggagactgaatggctggcagcctcactggggagaaatatgtattaaaccaattcattctctctctttcaccctctctctctctctctctctctctctcacacacacacacacacacacacacacacacacacacaacattattgagaagggaggaaatattctggtaaactggaacacatccaaggcccttccatgatctatttcaaagatgaggatcctaccttggatttgtacaatgatgctgaaataattaaagaagagaagtaacaggagaaacaaatggcaaaggactttcatgagaaaaatgtcccaaaaggcagatgaaggcatgtccacacacacagatatggaatcaaagaacttaacagaataatcacttggttaaaataacagctcaaaagggaggaaggggccaaaaaacaaaaaacaaaaaacaatgataagccagcagagatcaggagaaaaggccagaaaagaaatgttggctattatatcaagcagggaaaaatgaatggatattaacactgcaggcagcatgggggacaggatctgtggagcttgagaaaaatgaaataggaattaacaaagacttcaggaattcaacagaaaaattgagaaagacaggggtgatctaaaatatataaaattaatgtccctgaaatagagaattaaaataaaggagtaaaacacatgtttaaagttataaaatttccagaaataaaaaaagtcttgtctacaggggttaaaagagcatcttatccaggaacctctagagcagggatgtgcaatcttttggctttcctgggccacactggaagaagaagaattgtcttgagccacacataaaatatactaacactaatgatagctgatgagccaaaaacaaaaaattgcaaaaaacaaaacaaaacaaaacaaaaaactcataatgttttaagaaagtttacaaatttatgttgaaaagatatctgtactcccatgcttcactgcagcactattcgcaatagccaagatacaaaatcaacttaaaagtccaccaaggaataaacggctaaggaaaatgtggcacacacacaatggaatactattcagccatgaaaaagaaggaaatcctattgtttgtgataacatagaagaagctggagaaagttatgtaaagtgaaataagtcaagcacagaaaaacaaatacctcatgatctcactcatatgtggaatctaaaatgattgaactcatagaaacagagaacaaaatagtggttaccaggggctggggagtgatggaataaggagatgacagtcaaagactacaaagttgcagatagagaggaggattaatgataagcatttatgatgatgggtatgttaattggcttgattcaacccttccaccttgtacagatataatatcactgtgtaccccataattatgtaagattaaatttgtccaaaaaatttttaagtattactgggcctcaagcttctccttggaaacacaacgagccagaagacagaagagttacatccacacagttctcagaggtggcagacgtgtccaaccagaggcatatagtccagctagactcagggctggcagtgaacgatttcaggacttagactaaaatgactgtggaaggttctgatgtctctgtcgaaaatcagaagaacagaagcacagctatctgccttctaaacacatgcttctctgtaagataaacatcaaaatatcagattgcttgggacacatctagatgtgtcctaaaactgccaatgcccagcccagtacagcccagtgaagcagattctaagggcaggctccgctgcctaggtggttctcacgatcgctaaacagaacaagctcctgcttccattagtaagctcaattcacaagcaaaacaaaacaaaacaaaacaaacaaacaaaaaacaatgaaaagctccagctgagaacagtggttctgcatttcagctgcaggttaggatcacacagagtgctcttttcccagccctaacactcagaatctctcccttgtaaagctctctagagagcttagcatacagccagatagagaagcagttgctctagaattatctagaattatcacctctatgtggaaggttctggggttcaaaactgatccaaacagagctgactgcagaagtgagcagcagcgcaggctcccaaacagaggggaacaagcacagagccgagcacattccccttttcacgtgggactataaagaagtcacatgaaaagcatcattcaggaaaacatttttagtgaatgaaagtgttaactcaatgtttagacgtatcaattttgttaagacaataattcaggaagaagaatcttgatcgcgccttttgcagtaagtggagcctgagtgctggtggtggggcgaagctcccctaggagggcagcacgtgactgcacttcctggagtcaggctgaatcatgaaaggaagtcctataattcacaaacccttcaaaacgacttctcttgtggccttttatctctactcaaattaagcagcacaggaactccagagacaggccaaccacacatctctgccccagcgcctggagtgaggcaaggttggagccgaggggccagtggcaggaccccacctctgctcactggggtgcctcagaaggctcccctctcagcctgccttgattacttacaaaatgagcaaatggaaggcattcccagaaacaaacgccttatttcttggtcttgaaggtacaagggccacttgcttggcatcttatttttttgttttgccttcgtgagaaacacgttacctctctacatcttcttttcaaaatggacaaaacctcaggttccaaatgtttcaaggaaactatgttggattttttttttttaaccgaagagaaaggaacaagcactaaggttttctccagtccctcaaaaccctcttgagcaaaaacctggtttgttctttcagaaactattctgaaccaagtgtgcttaccccaaggatacatgacttagtagctttctccaaggctgtgttaccgcttggagggctgctgcaaggaaataactgggaaccatgtcagttcccgggtgactgagaagtaacattattttgtgtgtgtgtgtgtgtgtgtgtgtgtgtgtgcacgtgtgttgtgttgtgcaggagaatgttacagccttggggatgaaaagggccaggccagggccccatggacaagactcaaggtctcatgtcaaaggagagggcactcctggtgccctcatcagttcccagggtcagatcctcttaagaaaattgggagctgcaggtatcaacacatgaaatagtggcgagtgttaccgtgcacttaggcaaggagtggcactgagaactgggaaaggggagaggtgggtggaagttcatatcccttctgggctcctcaggggatgggctgagagcagcttggtgtctggcagaccttgctacagcaatggaaatacctgttctactctgcctgacacacaccttccacccacgtgtggcaactggtccctgacacctggcctgtgtgactgagaactgaattttaaattttaaatgaaattcaacatttattttaaatggttttaagtaattgagcggtcagtggccacatgtggccagtggttccataatgaacagccttagcagggatgacagagaccaacatgatgagctgcatcttataaacacaccgccaggaccagagtctgtgtggtcctggtacttcccccttccagaaattccttctagttgggccaaacttgaaggctttgggttttcttttgataatgggggtgatacatttttcactaaatatctagttgactatatccaagtcatatctgatatattacaatatgagaaataactttaagagtgcccacaatatgcaaagagggtgccatgctgggagcagagtatacaaaactctccatgccatggtctctaactggacattttaaaagagcaagggccaaagtcatgcaacaaagtcttttagagcttctgagtaagatgccccccgggggagtgaccttgtctagtgactggggatgtgagagtggaggacaacgcaccccctatgtgttgcttattaaacccagcagagccctaaacacatgattaggatctagacacagcttatttgcttatgatactgttgggcaagagtcactctgtttctgtgaccctcttataaaatctttttgcttgtaaaagaaccctgtcttcaattccctggtaaccagtagctatttatccttgacatcccgcactcaaccatgaacatttgacagagggcctattctttgtgagccagtctgattggtgctttgcatacagcatctctgagcttgatagcaacccaagggttaggtatttttaacctcattttgcagatggggtactaccagcccccagcagttccagtgaaggatggaatctagaccccgaggcctggtctgcttctgacaaccactctgcccccagagagggctttagagccacttcttggaactggatgtttacaggtctaagccacaattctagagattttattaaaaagtgtaaacatgggggcaggcgatgagtccaggggcccttctgggcgagtatggcacagtgctgatggaggtggctggggtggggaggtagcagcagcggcccatcccctaatgactcacaagaacagcccttctggtcaccatcagctgcagccagcgaggcccagaagccaacccacagacaccaagaaactatggaccaaactctcaaccaggagcgaaattgcttacgtccttctcacgagaaaaaaacatttctcatgaagcatgcagatggcaaatggtctgacagaataaagcatggtggactaagcataatgttaaaaaaaaatcttaaagacgaaaaccattcaaatcctcttgtgtagaaaatgttacaggtcagttttgctatctgaccagtgcacatattcttcctctgagaattatttcatgtgcattcacctcctgcaagtcttacagttgcacgctgagaatgcactgacattctcactctaaagccttcctccaaaagttctgcagagtggcaaaccttaggagaatataagttcccgtggaaaggactgttcgcaacagaaaaacacgagccctctctctctcaatctctctctctcacacacacacacacacacacacacacacacacacacatatcaaatggggaggagccactctggcctgcccagtgtctttgcagtcaaaggcacacacagctgccattatacccagcataccaataaatcccaatttggtggaaacctcatcagcctttaaagatgtgtttgtgtgctatgaaatcctatgaactagctgtcaaatggtggtcctcaatcttggctcctgcactgggtggggtggagtaggagtggctttaagaaacatctgaaggcaggctgcaccccagagcaccccagtgtccttggaggtggcctgggcttcaggacctgagtgacagcagggtgcaagcatgtttgagaccatggctgtacacctttgggtgagctgctgaacctctcaaagcctcgctcttcattggaggacagaatggtgccagcagtcatgatgcatgatgtgtttctaagttacttctcttcctggtctcatcctacttaccctttccccccaagcaaaccttattattatcatttttctaaattgaaaaaagtacacactcctgatcgttgtaaatactgcaggcacactgaagtaggcagaataaaaatgttaatttcacctttttctctaaaccaattctattcccctccccccaaagctgctgttcttaatttggtgcttacacttccagatcatgctacatatttacatacacatgtgtacacactggatagaatatgtataggcagaaatgcatgtataagtagtaaacgacaatccaatatcacttaaattattatgtgcatgtgggagatttttaggttttttttttttttttcacttattatttttgagacagggtcttgctctgtcacccaggctggtgtgcagtggcatgatctcagctcactgcagccttgacctcttggactcaagtgatccccccacctcagcgcccccatgtagctgggactacaggtgcacaccaccagtccaggctagtttttttttttggtatttgtcatagaggtggggttttgccatattgcccaggctggcttcaaactcctgagctcaagcaatccacccaccttggcttcccaaagtgctggaattacaggcatgagtcattgcacccaacccagcatgagttttttaaacaaatacaatgatatgttacatcttgctttttcactagtagaacttggacattgttatatttggtgtatgaaataaattccacattttttagaagactgcataggattccaacatatgaatcaactgtacttcccttagtgatttttttttgctattataaaataaaatgttgcaatgaatatttctccacttttgtcaatttatatgtgtgataggttcctaaaagtgaagttgttgagtgaaagcacttgtgttttaaattttaaaagatattaccaaacggccctgtcagcacccatctgtgtcttttttcttattgatttgaaaaaactcgctgcatattaaagctattgatgctttaccacaagtattgaaattaaatatatcttaccatttttttcacttatttgtatattttttcattttatggggatttgcttaaaattttaggaaatcatgcttatcaatcttgtgatgagtgtgaatataaattcatatgttttatcacatttagacaggcctcttcacaattattttaaaactcacctaagttttcttttaatagcttcattatttcaatgctatatttttattctttgttcagcttggaatttattttgatataaagagcaaagttttgtttttttttccaaacgatttgccgttttcccaagaccattcatccatggccctgcacctcccccgcctggtgtgcaaagcctcccttggacccatgcctgcatattatctgggtctgggctctactccccacagcagcttcactttacaattttgtggagtttgtctcccttaacacctttatcttacatttcttccctgagtcttctcataagtctctctctctttaagtttttgcacatctaaagtgaaagaaacactttaccgtaagtattttaatgtgcttaattgtgtttggtcttcacactgacagagttctggaatcatctgtacagcaggctcatttcaggggccttagacatctgtccatctccatatctggagagctccctggtgctcttgatggcatcacagaaaggccatcgtggggaggtgccagtcttcactcacacatttgttacaggttgaattgtgtccccccaagttcaaatgttgatgtcctaactccctaacccctctgagtgtgaccttatttaaagacagggtctttacagcagtgattacgccccattgaagtccttagggtgagccctactccaacatgactggtgtccttacatgaaaaggagatctggacccagagacaggcacacagggagcatgccatgtggagctggagatggtcacccacaagccaaggagatgctgggggcacattgtcccacccaacccttggaaggagccaccctgggacatcctgacctcagtctctttggctcagagttgggaggcgacacattgggctgttcaagccgttcagtatgtggtgctttgttatgaaagcctgatcggactgatactccattcctccataacagacactgacacagcttccagagtcttctgagaagaaacaagctccggggaataccttacacactgctggcttctttggggaaatcatccctcacaaacgcttgcctttctagcctgagcccttctccccagctgccaagctgcctttccttgaccaaatcattgaagtcccacctgcctcacaaacatttccataacaggagggaaacgggtctgagatctgtccacacctgtccactcccaaccctcacgacagcaacacaagcagagagcagcagttctgccccgtagggggacagccacagacatggaggtctgatgtgggaaggacagagacactcacagctaggggctcggcactcactttccacgaggctctagttcactctggatagtaaatttatctctatggaaggaaggcatgcataaaagcttcagctcttctcacttgagtctctcattggtttgggattgtgtctaattcctattgtatatgcttaacttctcaatgcaaaagccacaaagatcaaaacaagttttgtgtaaccattggtgatgagtaaaattggcatgtctgacactgagcctgtgtcctccctctgcctctccaggctttcctgagctgctgacaggactccaaacctgcccaccaattaggcaggacagcagatcctcttttacgccttattagagtagtggatagggattctggttctggattagaaacacctagttttgagagttctaatcccagcagcatcactcagtggttggacaaatcccttcacctttctgagcccgtttctaatcgggttgaattagatactctgcatatttaaacaggcttctaagaatctatgaatttggaccctcggtatcctaataagcaggacagacttcatgacagagctacaagatcaccagcagtgatttggggaacctaacgccaaggcctgcgatgcagcctgctctagccaggctcttcctgagccctcactgtgagttccttcacgtagccatgaccatcagctgattggtgttgttaaccaaaaggaagtggtggccttccacctcaagcatatgcacagctataaatgcagagaaggggaagaaacatgaaaaacagtattacagaaaatgaagtcatagcacgctgaggatctgaggagatgttccatgagtagcttggcaatgaatgctctccttgaaaggcatgaagcaggtcaggctcacactgaagggggcaatcacagtccccctgtgcaggcaggcagcagtgtggggggtgcaaggtgggagaagaccaagggtggagtgccttagaagcgacagagacctgagggaggaacagggaggagcgggaggacaagggaagagtagatgctccccagctccaagaaagcagcagaagacgcctcgcaggaaaagacaggtgtgtggcttcgtttgaatagggaaggcatggccatacccacaaagaacagggagttcctgccacccacacaccacacagaccagttatgggcccatcctgccctgtgcacatccaggtcttgccctcctcctatctcatgtgggacaggctgcaagaatgcagccttaaaagactaatgcctagggtacctaaaaaaaaaaaaaaaccaacacacacgtggaaatacccagcacatcaggaaagctgacagcaggagagagaggcaccaagcatgcaagcagatgaactgataccccgggagacgggggtaatggtgcactcaaacaagtaataaaatacacagaaaactaatacatcacttaaaaaaatcccaaagaagtaactacattccttggaaattaaccacctgcttgctaaaataatcataggaaaactaagtggatggactgaagaacaggatggacagggatgaagggcttccttgagataaagattaacctgatggtttcatgaaaacacagtgcaaatggcaaaggagagggaaagaatgaaaagaaaaagtgcattcattgcagcactgtttataatatcaaaaattaaaaaaaatcgacatgcctattctggactgtcataaaaattacaataatcactgaatatggagacctccccgcaccccaacatattaataaaaagaaagttccagagtgataaaggtattaagaagacatacacagcccaccattatatcttctgaagacgtgcacacatgcacacatgaatgcacaggacgaaagaagagaggttagagctccaactgctccccaacagtgggactgggggcagggctgggactgagggtggaggttaagaagggcttttctgttgctcgctgtatctgaatcctgtactaaaggatatgtactcgtgtatcagttatgcaatggacaactttcctaaaagaaaatattagaaagttctcccatcttggaggtcagagaaactaactttggcaattgtagttgctcatcaaacctatctggacgtgccttccctccaagactgcagggcagattcccagagtcagcccgcctgggagaggctctgacagttatgtcagttttaaccacataccaggtaccgagcactgcaggcacggtctccattaggtatcagagtgaagccccctgtgactgctccatttacaaaagaagagcttacaaataaagaagggggacttgaacccagtggggcctcagacccttactctcaacccgtagctacaaaaatattcgataaatgtcactttgaggcagtgtatccaccacataattcatatattgttagcatttaagatgaaaacaaccacaacattctgcctctaccaagcaaagcctaaggagcttggtaaggagcagcaagaggtcatgcatggtttcccaaagaggctgtggcagagccagccctgaaagccactctaagaacaaacgcactgcagggtcatggaagtgtaggaccactggctgagactgactctctcagagaatctctgtgcatgttacctgcacaaaggctctgaagatgcccatgatatttatccctgcttgctgcactttatttcattcagcatttctcatgcttacttacttgagcaagcttcccagggaattccacttagcactgcagttccacttcaggaatcaatcaaggaaatcgaggagaaggccagcaatctgcttaaagtctcatgagatctccatttccacaaaaataaacattctcatcactcagataataaaatgttggtgtcgtatataatacaaaagtgacattgacactgatgtaaaacatagatgctaactgttaaagtggagttaaaaaccatctctcactaagcatgattcagaatgcaccctgatggaagaaatcataaaagttctatactacaataaataaataaccatagaattaaaaagctctggagaaatattttcaataattatgacagtggatttacaacaggtaaaatgtaggtgagtgttaacaagaggcatattaatgccacagatgttacaacaaagagtatgataagcaatttacataaaacatatttagtcaacaaatattccccatagggctgggcacagtggatcatgcctataatcccagcactttgggaggctgaggcaagaggattgcttgggcccaggagtttgagactagcctgggcaatatagtgagagcccatctctacaaaaaagaaaaagaaaaaaaaaaaagaaaagtcccacaccaaatatcctccaaacattcttcaggtattactgtatgtatagcaagactgaagagcaactgttagacaagaagaagatggagggttctagaaaaaaagaaagaaaaatggaaccgtgagattacttggtatatctgacactgtagaaaattgtgtcaatagggctttcatctttatgtcagaaagttgggaaggaaatgataataggcacagtgcaaactaagaaaacacaaaaacaaagcaagggtttaccccaggaagagcaaaaaggggtacgagatagaaaatggaatgatataccttgctttagcagtaaactatatttatataaccataataaaataaaccaaataacttcttaatctcaaatgagagaataattatcctgggatggtgtgagaaggagtagaaggtgatggtggtctaaaactccaaagtcctgaattctcagtgtcaacaaacactgtttaaaattagtacaccaaaaaactttgaaaatatgccaatcataaggaaatagtgagaattctagaggacataactcaaagcagtaccaaaggatgggcagaatgaaaagaggaactcattacaaattaaaattaaacaaaaagagaaattaacttaggtcacaccaaaacattttcatgtcaactcaacaggaactgatagatgtaatattaataaactaccaggttgaccatgggaaaataaagatttatcagttaagacaaaccaatggaggggagaaatgaaaggtcatatgttgaacattcaaatgctacttatagtcaggcagagtatacttaagtaaagcaatatttaaactgtggatattcctaaatctctgccctgggccctccttctgttgaatttactttctctccctagttcacagtatccaggtcgagagcctccctcaccctgctcggtagacctgcagcttgcctgcaaggttttcactcaggtcaagacatctctcatctgcatcccaggctaaaagcccactgtctcctcacacttatgctcccttccagcgctccaggacagcagtaactggaagcgcctctccagctcagagccaggatcccagtttcagagctagacacctctgagcagaggaccagaaagctcacagtactcctcagtaatccagtaatcatcaacattcttaactgtcctcgcttgctccaccaccatctgcctttggccagctgccagaaatcaatacgtggtgtcccagaaagaaaagaatcaagggagccatttggatttattaaatgtactgtaacataaacaaaatattctttctttgcatatctttggtcttggctaaattcaactgtctttaagattccagtttaaccaccttttaagagatgtagggcaaaccttgcacaattgattcataaaggaaaaaaaaacctcaaattgatacaagctaatattggtcagataaaattataagcaaatagaaaatgtccctgataacatcatatcaaaatgaatgaactttcctaaaatccaatcagactagttcttaaaacatcttcccacaatccctcagtagaaaacccttttttcctagtattcaaatccaacctgttcaaatctaagtagaagaggaaggtgataagacacaaatgaggcaatttgatcataatctctcattaggactctgccttctgattttagttgctttagaagaaaaagtaatgctcaatgtgtagacttctaaaacaaaacaaattcttccccaaaggcctaaattcctgttgttgttgttgttttctccacccagttatagctaaaccaatccagaagtagtggaaaatgttaaaaccagcaaagcaagagtagaaaagtcagggggtagctggaaaaaaatctatacagggaaagttgagaaagtaaaaattagccatcacttaggcttagataactgacacaaacccagctggttgcaaagttaacaggaaataatatttcttccatggacagactgcagctgtaaagggtgacagtaacccctcctgtaagtaacttctgctctgtttctctaaaatggtagactgtcagaaactatgctgtttgaaattatattacaaagatgagacatccactcttacttgaagtacctctattttgatcggtatgattgaaaattcagtaaaatcttgctatttaagactccctaaagagagaggaactgcccttctaattactggaaagtgtgaagtattgaacaacataaatgcactttccttttaaaagcaaaccgtagttcagtggagtctaatacagactcagtccctcagctgcagctctaaaaagctctgaaaaacaacactttttttttttttggtaagtcttagagaagctctcgtagtgataacacctgctctaaacagacacacagctctttatagtctttatttattccacttagtgagaatattcatgttcttaaatgtaaaagtacagaaatattaatgcatggaattacaggattctctccagactatattggaatggcatgtaaccagcagggtcaacatgtatgtttacctttctaaattctgagcaatgtctttctcagttctgaaatttagattctaaattttaattccaaattctgaaaaagcttgaattccaaaatacgtcttggcacaagcatattggattataaccatgggcaaacaatgtgctaaataagtgaagttctactaagaagtcttccattaaaaaaaagcagagagattagacctgcatttagaatattaaataggggcctaacaaagatcagggtgattcatttctaaagtgaaatctagcaataaaataacgtttctaccaatttcatctctcaggaaagataaagacctaaagtatacaccccatttttatcctagcttaaaactttctagttattaagactattataaaatcctattttatatttcacttcaaatacagaggcttaaaaaaaaatcttcccacaatccctcagtagaaaaatctcttttttcctagtgttcaaatccaaccttttcaaatccaaggtagaagagtaagaggataagacacaaatcaagtaatttgattataatctctcattcaaatacactttaaagtgcacttcaaatacaggggataatacaaatcaatttctgttttaatgcaagagttttctaaatacgttaaaacaaaagtgccgttcagaacaaaaatgatttgataaaataatttcaactgacaaagatttctcacttaaaacacttaataatttacatgtatttaagcctttttgagaaaatataattctatctatgcactgctcggactttcactggggagaaggaggacatcaatgtatttagttgcatttaattaaaatgctgcctgtgtgaaggcaatgaatttgtccctactaagacaaagaagtcagatggtagaatcaattccatttcttccaggaactcttagggattaaatggttcctttttttatttttaataccaagaatcagatatggcacaacatcttcaactcttttttttttttactacacgctgcaatgctttgaactctacttgagttcgactgaatctttgctaagtcaggcaaaactcaaaaaatattttgcaacactgtttccaacgtaaaaaaagattcaaactctcacttctccaattgtctttctagtccttgaacattccaacaaaagaatggattgcatttatatagtttttaggtgggcttaaggttttggagccacattgccaaaaacagacaaacagacaaaaagaaacacccttaactcttaactcaaatttacattttactacataaaactttcttgctctccaagttcattggctaagtaaattacttgacaatgaaaatgtatccacaagagtaattatgctaaattttagtagtggttcagaagggttgttgtttgaatgcaactgctgtttctttttgtagtaaaagatttgtctaagctcataagacgtctggacatttctactttgagtaactttgataaacactgcggcattttccagtggattcgtgtaaatggccaaaggaaaatgttctagctccaagatcgacttcctcgcgctgtgcctgatcccaatcccgcgtctcccgagggccgggccgcgaccgcactttccgcgctccctgggggcctgggcgccctggggtgcccgggtcactttccgcacggtctgacctccgtcccctccgcccaggcctgagcccctctctcccggcgcagcttctggatcccgagcgcgggtaggttcaggagcgaagctggcggaacccacctgtattttattcacatggtttcagcacttttacctcggccgatgaaggtagaacaagaaagggcatgaaagcagcgcgtcgttccccgtaacctcctctccttaccagaaagtcccggccgggtaggggacgcggccacacctacctgcgccaggtgaggcgagggcgggcgcagcgcggggccacccgctcctcctcgctctccagccgccgccggggtggcctcagccgccgggcccgcggctcttcctcattttgggcaacttccttaacgcgcccgggcaggcggcccgcacttcctcccagtgtcgcgccccgccgccctggcccgccctgctgaccgcgcccatgagcccggagctgggcgggaatcggctgaagcgccgggcgaggcccgcggaatcggcccaggcggcggcaggtgtagaggagcccgggtggggcgcgcctctctcctcccgccggacaagggcccttcgcaggcagagaaggtggggctgcccgggacatggaccgcatcggtccccctcctccccgccagcgcggtggcttctgtgactgcccaggacccacagacacccagcggccctttccttttgctatgcagtgccggggaagagactccactgcatggcatattccctggagtgtatcttggtcaccaaaccaacaagctccaagctactgtgctggagcactcgggaggcctgggcagtgctgagagggaccctgtaggtgaacaccagacttcacggcgcactagtgggcaatggggcacgctgcttctgaaggctttaattattacaaaaggctttgcttccttcttaccatgacggctctgacgtccacaaccaaataaattaaacctatagccctaagaatggttttgagatacccgcctgatacccttctcccaacccatcccccttttccttttggacattcctctttaaaatgttcccacaaaacggcatccagaccttcttgataacactggttggcagtgcctgttttaaaaagctttaccctaagccaaaatgcgagaagcaaaaaaatatatatataatgtgctggattgtaattgccatggagaaaatatagggatgggactatttacacttattggagcccccagccttttctgcttccagggttattggattttcattcatttttgccattattttttctaaacctgttaaaagaaaacttcagcagaattaaatttaaagcagtttaattgagtaatgaatgatttgcgaatggggcagcttccagaatcacagcggattcagagactccagggatgcctcatggtcagaacatatttatagacaaaaaaagggaagtgacatacagaaattggaggtaaggcagagaaacaactggattggttacaggttggcttttgccttctttgaacacagtttgaacactcagcagtgtatgaatggttgaagtatggccactgggattggccaagactcagctattgttaaaggcacatactcctaaattaggttttcaatcttgtctgcctattaagctaggttacagttcatccacaaggactcaaatatagaatacagagtccttctcagatcatacttaggttgctttaacaaacataaatggaagattttgataatggttatatttgcttatcattggacttaattttgcttcaactacccgaaaaaatagccattgttcctgagatggagcctgcagaatgtctacagatggttttcagagttgtcagcattattggagatgaacactaggggaccagtgtgtacaaagcaaacccagcctgcacaaagattgcagttttctcaggctttcacctgatggaaatgagggggaaattctagatccatctacaacctccttcctttacactgctgtgttcctttccccctttgagtcaccttccgcattacttagtatcatgtagtaattttttttttttttgagacggagcctcactctgttgcccaggctggagtacagtggcccgatcatctcagctcaccgcaagctctgcctcctgggctcacgccattctcctgcctcagcctcccgagtagctgggactataggcgcccgccaccatgcccggctaattttttgtatttttagtagagacggggtttcaccgtgttcgccaggatggtctcgatctcctgacctcgtgatctgcctgccttggcctcccaaaatgctgggattacaggcgtgagccaccatgcctagcctaaaagatggttcacattatgtatcatcagggaaatgcaaatgaagacagtaagatatcagtatggcccaaattcggaacactgaccgcagtgaacactagtgaggatgtgaagcaatagaaatactcattcattgctgttgtgaatgcaagatggtacagccactgtggaagacagtttggcagtttcttatgaaactaaacatcctcttacaacatgagtaattataagaggattgtccttcttggtatttacccaaagtagttggtatttacctaaagtagtacccagtaattgtgcttcttggtatttacccaaaggagttcaaaccttatgttcacacaaaaatctgcacacaaatgtttacgctggctttatttactaagtttattgccaaaacttggacacaaacaagatgtcattcagtaagtgaatggatatataaactcttgtacatcagtgtaatggaatattgttccacactaaaatgaaatgcactagcaagttatgaaaagaaatggatgaaatctaaatgcatattaccaagtgaaagaagccctctgaaaaggctacatactgtataatttcaacaggtgatattctggaaagagccaaactatctggatagtaaaaagatcagtggctgccatgggctggtggggagggcaggatgaatagaaggagaacagagattttttagggctgtgaaagtatgctgtatgatattacaatggtggatacacagcactatacatttgttaaacaccatacaatatacaacaccaagagggaacatcagtgtaaacttcaggctttgggtgattatgatgtgtcaaagtaggttcatcaattgtaacaaatgtaccagtctgatggggctgttgataatgggaaaggctgtgcatgtgtgaggtcagtgggtatatgggaaacctcggtacctgcctctcatttttactgtgaacctaaaactgctctaaaaaatagtgtttaatttaaaaaaatagtttttttggtaacagtggcaagtattcctaataggcaatcccttaaaagaataaaagcacaaaggaaatagaaacatcccaaatttcagacataatcatcattaccgttaggtgacccttacaaaattatctctttctatatgtacacatggcaatagatataaaaatgggcatcattttaaatataatacatttattatacattttatccatgttaaatatgatatttaattctacttaaatttaacagaataaaaaattctgaaatgggatctaaagaattgctgattttatagaaatgattctttgccacaaatgtatcatttctgaaatgaccccactttgattaaaggaaaagaaaagtgacaataataagcagttttcgtcatttcttctaaaccatgagctttaatttcagacagtatcagtaactctgctatgatacatgaaccaattacctctctcactccacttcacttcagctcacctctcacgtttccctagttatatgagttttacatagttaagtttaaaatttttgatttctgtaaccataaaccctcagtggtctcttcttagttctccatttaaaaggataccttatgcacctccagacctttctaccaccatatctcattcctactttctttgttgatgagctggatggactctgtgaagatgtgatcccacatactgcatctatcaatgctctccactttcaggatgttattctgttgctgttgtattgcagtgacatcaaggtgggcacattgtgtctccatcctacttccctttggcctagactcggttgattttcctcccttgcccctttggcattgaatgttgttttggagaaatgtgagaacagccagtcctttgtcctcttttaggtgacttgctcttctttccaggctgctggaggaaactttctttaactgagatattaagaaacttgacaaggatatatactgatacagatcaaccagcatcttttatttctttttctttttttgagatggagtttcactcttgttgcccaggctggtgtgcaatggcgtgatcttggctcactgcaacctctgcctcccaggttcaagcaattctcctgcctcagcctcctgagcagctgggattacaggcgcccgccaccaagcccagctaattttttgtatttttagtagagacagagtttcaccatgttggccaggctggtctcgaactcctgacctcaggtgatcatcctgccttggcctcccaaagtgatggcaggagtcaccacacccggccatcttttatttcttaaacacaatgcactctttaatgcacatcataatcacccaaagcccaaagtttgcattgaggttccctcttggtgttgtatattgtatggtgtttaacaaatatataatgctgtgtatccaccattgtaatgcgcagatttagatcttcattcaaagaattttttcttgtgtgattttaaatacctttttatttgttaagtgcttttcttcaaggatattaattaactttttatcatctaagtctattatcttttctctgattgtagtaatctactttgttttttcttcctggttcacagtgattttctctctctccctttcttttttttcgggaactaaatgtttagctgggtctgctttatttcttgttatttctaatttacctgtaggtaggtttattggtcctcaaattatttctttgtctctggttctctctatctcactctttttagttattttctcttggttattcaatcggttcttgagttttttaaaaaattgaatgcaggctcttatcaaattttgtagcctgtgcacttaaaaattctttcagactggattttatttttaatttgtgcatgttattttcttttaaggtttgcatagctgctagttcattgatttcatcttgtccatacttggcagctttcttcagactttcactttgctctgcccctttgtgtgtggcagctcctaaatcctcatgtcagagccttttcttaccccttttctggattacatatgacggcttaatattccttttgagcttgattttctataacctttgagcgtgggaatggtgggggtgggcttagctggagttgtgttgcacaaactgggcccctccttccaatgtgagactgtgaggaacatgcaggcttcgcacttcattgagggagggagaaggctgagcttactctgtccagcgaggttgggggcatctgtgagtttcagctcattcccccaattaatgtgggtcgttggagtcctcacactctgacaaaatcatgccacattgctgctatttccttttgcactaatctccactgcagccattttcactactccacagtcaaaaatgagaaaaactaaggataaacaatggccccttcttctctcaagatctgagtgagaattgttcaggattttgtagacgcacaatatatggtttctgggaggttggagtgtggcctcattgtgatactctcaaacttctggtttttatatgagccagcgcttttcaaagtgcattttgttaagcggttctccttttcttgtttggttaccacttgtaactttagcacttttgtttcttcccgcttcccttttttcttgaggtagaaagatgaggaaagtaaggattcttttcttctagatggtgaggccttgatattctgtaaatgtttcactatgttctttcagaatgtaatggcccacatgttttttactatagaatatacgctgtacttttttttttttgtgacagggtcttactctgtcactcagactggagtgcagtggcgcaatcacagctcactgcagccttggcttccccagctcaagtgattcccccacctcagcctcctgagtagctgggactttttgtatttttagtagagatggggttttactacgttgccaggctggtctcaaactcctggactcatgtgattgcacattttaatatttagaatgtaaggtcctcatttttgtctcttctaaattaaaaaaatacacaagttacacatgatatatctgttaaggtgctttaggttgcaagtaaaataataaccaactccatgtattgaaataatacacttttattgacacacaaaggagaatattgcatagttaggacagcatcaggtgtatttttatgcatattacattaaatttagataaaattaattattttcatatgtaggtatacctttaaaaaaaaagtaacaaccctattgtgtcctatgaagggaagttaattttgatagaccagcatgatggaggtgagtggcttctctcagtgattttcaccttctgatcacattcatccagttgctgaaatgacacaggatgtagccagaggaacaacttccttctgctggtattccctaaccaattcaaccagatataaaagtgacttttcacctacaaatggtaaacttcctcatttttcttttgttagtaatcttttgaacaaacaaaacagaaaagttacttaaagaccaaagatagtgtctgaagtgtgatcacatgtgtttaaacccagcggtaggtgcactggccacgggtcaggaagcacgggccatagtagtctcagctctgctactttttgtaggtgtgcagctctgagcaagtcaagtttcctctgtgtacctgattccttatttttttgtgaaattccagggagcaaacaattcaataattgaattagggtcctttacttgccagacatgacccaagccactggagattcaaaaggatggaaaaaacttatgctcaaaaataactcctccctttcatctatttcaatgggtagctaatcatttgcttaacagagtactcttttaaaatataattatataattagaaggtagttcagctgttatttttcactgtagtgaaaattagatggtttttctcataccaagatcttttcattctttttcttttttatatttttcaaagtgcggttccatttttaagttttcaaaagatataattcacataacatccagtttacttgttgaaagtatacaattaaattgttttaagtgtattcacaaagttgtacaaccatcatcactatcaatattagaacttttttaagcactttttttcttttttgtgaagaatggggtctctttatattgcccaggcaggtctcaaactcctgggctcacactatactcctgccactgcatccttaagtgctaggattacagatgtgagccactgcacctggaagaacttttttaaaccacaaaacaaaaccccatacccatatcacttctcatgcttcccatcccacacaatcctttccctcctccccatccaaggccctaggaaaacctcccatctactttttgtctctgtagacatgcctattctggacatttcatataaattgcatgatgtaatatgtgctctttgtgactggcttatttacttagcataatgttttcattcatgttatagcatacatcagtgttttacatttttagtaccaaataatattccattgtatggataggccacattttatttatccactcatcggtttctgctctttggctactataaataattttgcatcaaccattcctatacaagtttttgtgtgggtgtatattttccttttttcttgaatatataactaggagtggaattgctgagtgatatagtaaatctatgtttgtcattttgaggaactgataactgttttcaaaagtggcttcaccattttcaggtttccaccagcaaaacaggagggttccaatttttccacatctttgtcaactcttgttattgtctgtcgttttgattatagccatcctagtgggcgtgaagtggtatctgatgacttcattttcatttcatttatgactaacaatgctgagaatcttttcatgtgcttctttgtcatttgcatatttttggagaagtgtctattcagatcatttgcccagttttcaattgagtcacttatctttgtatcattaagttgtaagagttctttacatattttgaatacaagtctcttattagatatagaatttcccaatattttctcctgttctgagagttgtcttttcacttttgtgatggtatcatttgcagaataaaagtttttaattttgatgaagttcaatttatcgacttttttcttttgttgtttatgcttttggtgatgtagctaagaaactactatctaaggtcatgaagatttactcctatgatttcctctaggaattttatagttttaactcttacatttatgcccaacatccattttgagttaattttcatgtacaatatgaggcaaagatccaatttcattttttttgcatgcagatttccagttgtaccagttcaacagtagttgttaaaacaattattctgtcctaattgagttgacacactttttgaaaatcaatgtaaaggtttatttccagacttccaattctatttcattgatctgtatatttatctttataaaactaccttttctttattttattttattttattttattttattttattttattttattttattttattttattttattatactttaagttttagggtacatgtgcacaatgtgcaggttagttacatatgtatacatgtgccatgctggtgtgctgcacccattaactcgtcatttagcattaggtatatctcctaaagctatccctccccgctccccgcaccccacaacagtccccagagtgtgatgttccccttcctgtgtccatgtgttctcattgctcaattcccacctatgagtgagaatatgcggtgtttggttttttgttcttgcgatagtttactgagaatgatgatttccaatttcatccatgtccctacaaaggacatgaacttatcattttttatggttgcatagtattccatggtgtatatgtgccacattttcttaatccagtctatcattgttggacatttgggttggttccaagtatttgctattgtgaatagtgccgcaataaacatacgtgtacatgtgtctttatagcagcatgatttatagtcctttgggtatatacccagtaatgggatggctgggtcaaatggtatttctagttctagatccctgaggaatcgccacactgacttccacaatggttgaactagtttacagttccaccaacagtgtaaaagtgttcctatttctccacatcctctccacacctgttgtttcctgactttttaatgattgccattctaacttaaaaccaccttttcaaaaattataacagtgggaaaattatgacagtggaaagtatctgatctaaccaagtttcatcttgccattagcctccaaactgcccttaaccattcttgggtctgagctaagttatcctggggagacatttagtttatagtttaaatgacaatagtcctttccccaaattaaaccacctttgtaaagcttgtgaaaggccaccaggttaggagggtgtgaggagcctgaattctgctaaggtgtagacataaatgattaccagctattatttagaggtcacaagttttgcaagtttcccaattactcctgcagataacatcaccgttgcagaaactaagattcgctttttgagataccttttaggtttttgaatttctgacaaccaatggcttcacctggatccaccaaccctgctgaccctgctggccctgctgaccccactgacctccctgaccccaccaaccctacggaccagtcatgtgctcccacccagaaacagactccttagcctgccatactatctttgaaaaatcctagcctccaaattttccgagattgatttgagtagtaacttcatctctcatgtggtgtggccggccttgtgtcaattaaactcttttattgtgatggtgtggtctcaataaattggttttgcctgtgcagtaagcaggaagaacccatcaggcatttacaagtactaaagagtttttagtactgcaactttgtagtaagctttgaaattaagaagtttgagtcctacaactttgttccttttcaatattgtgttggctattatggttcctttgcattttcatatgaattttaggatcagcttgtccatttatgtgaaaacaaaagctgagattttgatagggcttgtgttgaatctctacatcaatttgagaataaatattaaatattcttatcaatgaatgtggtccttttgtggatcttctttagcttattttttaaagcatggttttcgttacttcttggaacatattataaaccaaaagtaaattctaagcctcccctcctccaaccatctgaatggaccccctcctcttggccaagggcattccaaagttaacctgaaaatcccattcaagccatgatagggggtgctgtacataccttatcacaccctcctcctttttggaatagtactaaaagactctttaagtctgataagaaacattaacaatcaattctctctgaagcctgctacttggaggcttcatgtacatgataaaaccttggtctccataacctcttatcataactcagacattcctttctattgataataactctttcaaccaactgtcatcagtaaagctttgaatgcacctatgacctggaaactcccacttcagttgtcccaccgttctggaccaaaccaatacacatcttacacatattgattgatgtcttatgtctccccaaaatgtataaaaccaaactgtggcccaatcaccttgggcacatgttctcaggatctcctgaaggctgtggtcacaggccattgatcactcatatttgactcagaataaatctcttcaaatattttatagagtttgactctttttgtcaataatatttataataactcctttgaagtctgctaaatgcaccatctgagtccttataaaggcagtttccattgcctgtttttttatgtcccagtgatatgttcctgattctatgagtgtctcactattttgttgttgaaaactcaacattttaggctgggcatggtagctcatgcctgtaatcccagcactttgggaggccgaggtgggcagatcacttgtggtcaggagttcaagaccagccttgccaaaatggtgaaaccctgtctctactaaagatacaaaaaaattagccaggtgtggtggcacacatctgtagtcccagctacgtgggaggctgaggcgggggaattgcttgaacccaggaggcagaggttgcagtgagcctagatcacaccactgccctccagcttgggcaacagagcgagactctgtctcaaaagaaaaaaaaaagaaaagaaaagaaaagccaacatttttgataatatattatagcacgtctgttactgattgccctctgagggtttgttgttgcttgctttagcatgtgtttagggtcttggctggactccagtgaaatctatttccctgacaatgtgcagcctatgatgttgctcttccgtgagtgccatcttgggtgtggaaactgtctctctgaccatcaggatgactgtggtctgagtggggatcgctttggctctctctgtctctaatctccttgttgagcttatgtccggtttgttattggtgtcacaacagatcttagcctgttctagtggcctgctgatttctctgttgttctcaacaatgccctaaggtataaattcctccagtcaaatcccattaaagtcagtgctgtttgcaggacagctgttaccagtctttgaggcttgctcccacatcgggagacctccgaactgcctcttttcctctgttagtgttccagctggtctatgtttctcttgttgctcctggcatcattgttgctcctggcatctatgttttacttgttgctccttttaattgttaaggaccttcttgtttttgagaatacttagctgggactttgtcctctatttcaaataaagtcggcccccttagggtgagctagggagctctctgctcttacaacctgcctttccactgggaagaaactctgctctcttgcaccggacctgggagtggagacagtggcctggttctcctgggctgataccctgactctactagcagggcactgggtggggtcagtagccttctatgagtggaacttctgccttataagggtgctagggaagtggcaattagagtccctggggtaaagcatccactctacgagtgggggcttggtgggggaagggagccccagttctcttgatgcagtttcctgggatggagcttctgcaaccgggagatgggtgtcctgggatgcagtttctgcaaccagaagatgggggtgaggggatgggagaggcccaaggcctgcccctgctggggtaaaactggagctgtagactggagctgggggagagcacacccatcttcttggcagcctccacccagagtagagcttgtgttatgctgaacaccggggaggagatgagagcaggtcatggctcagatgatgcgggctcttgtgttcttactgatattttatcatttttctcaaataaatagttttctacttgctgtgtgtctttaggacaattcccagagatttttacgtgttttattttttataatttttgccactcaaagaattgtttcattggagagagtttcgacgaaactatccactctttcattcaagaactgtttctcttcttttttcctgaggcactgaagttaaagggtttttattgatggggttggggtggggaaagcagtgtgtgcctctctgggcaggcaggacagggcatggaaaataccaggtggaacactttggccaaccagattccaaggacctgaggaacatgggccaggatataggcctcctactgtcagattttcttggggctgaagtattagtagcaacctcctcattcctgacccagacaaataatctttgtgccctccttggagcctatgctgaagattacagatgcctatcccagacagcagaaaattaatcttacacaaccgacactgtgtgacaaataactagtctttttctttcagtttgacagtactcaaatggatttgcttattgaagttcatacatggtatgatgagtgacccacaggggaaatttagctaaatataaaagaaaaatgagaaaaattataacattattttggagagtcttctaatataaaatattaaatgaatggatgttaaattctgttacatattactacactgggattttctttcagtttgacggtactcaaatggatttgcttattgaagttcatacatggtatgatgagtgacccacagggcaaatttagctaaatataaaagaaaaatgagaaaaattataacattattttggagagtcttctaatataaaatattaaatgaatggatgttaaattctgttacatattactacactgggaatcatcatctattttaagtgtactcggaaaaaactgcctagaaacaaggaacagagattatattttctgactcaaatatgtttcagtatgaataggcatttcctgcttgtccatacacatctgttttattgaaaaatgtttgaaagagttgattgatttcaatttccaagtttgatctagggtcgaggttgctaccgtgaaactaaattcaaaatgacaagattattaagttatgtatattttgttattattaacccaggtagctgtaaaacttgattgccaagtagatatggaagagatgattgattgaccataattgtccacagttttgaactcttggctacactttcacctctgggtctgtgagtcctcaagatgcagctcactcctctccaaacggggtgctctgtgatttgtgtcaaagacaaaatagatctcaaggaaactctgggggctttgaggccaggtagggataaatgagtgcagaatttgtaagtagaacagacttgataaagaaccctctgatgtttcaaaaataatatataatagaaaaattaataaagggggtaaaatataagacaccccaaatcccaatcttagaggcaaatatgctccaacttttgttaatattttagtatctgtctctacatacagaaatgtaagtgtaaatgttgttacatatgtgatttagtaagctgactattggattagatagcatgttgtggaaatacttccatactgtcttcttattgactatatatcattctcttgaatgcatgaaccatgaggttattaaccaacccctgactgatacacagttgtttccagggttttgttattatgacctactatacagggaacactcctgtttatacatctttgatccttgataaatctctctaagagataaattcctaggagaaatgttgagagtcagaggagatgctgttttatttgtgacatttgttgctaaattgcacttaggaaagattcaattctggtttatacttccacctggtacaggctgtgctcagcacaggggtgctctctgagtctggtggggctgaaacctagaccaccctctgtttgaccagcagggagctgcatctgccccaaggaaggggtgcctgtcccttcatcatacacagtttctataggaacaggcaagctcctggtgtcaggctgtgagggcaggcatttctgctacctagagccattagttctaggcattattaatgttttcattctggggtaaaagagatctcatttttgttttacctctcatcctagaggtaaaagagatctcatttttgtttctaatttgtatcattttaactatagaagttgaaaactattttatatgtttgttgactgttcatatttatttcttttgtaaaatccttattcatcaaatttctcaatattttttatgagatactaatctttattgatttacaaagttttaatggattatatgttcatcaattatgttattaacattttctcgagttcattctttagttttctcttatttattcatttatttgtgccaacaatatgatttaaacgttttatatggaaaaaaaatcaactatgatttctagctttgatacctttgttattccaaatatataaaaatgttcactcctttttttttttgagtcttgcactgtcgcccaggccagagtgcaatagtactatctcagctcactgcaacctccacctcctgggtttaagccattctcctgcctcagcttcccaagtagctgggattacagacgcccgccagcatgcctggctaatttttttgtatttttagtggagacggggtttcactatgtttgccaggctggtctcaaactcctgacctcgtgatctccccatcttggcctcccacagtgctgggattacaggcgtgagccatagcacctggccaccttttcacatttaattatttgtaatccatttgggattttgtttggtcataaggagcaagatagagattctatttctttttccctagtggttagtcagtttatccaacaatccatcttctcctcactgattggtacttaagctttatcaaatgccagattgcttaaacacctgggtttagttctggtgtttcttttgcttttcattgatctatctaatatccaataggatgttgctgctttaattactacagctttgtaattttgcttcattataattttttttttcaggatttgagaaactctgagggcaaaagcttctcccctcacaagatgagattttaacttttattatcagtacacatagaaaatacgtatgtgtatggattcatagacaacagattctctgattcagttttgagaataactcaaacccaccaatcattgattggcaccatgttgggggattcacgcttctattttgagagtgggatggatagcactcagcatctcagtgtgtgcatcatcactggtgcacaagtcccctccagatgtcagctttgctctgggactggtttgctccatccctgggggcagaggtacatccagcaattttgctccggggtcctgtctctaggatagaagaggttttagaatctctaagttacagttttggagaactccaatatttataaagttctttcacacgttttacttcctaagacatctctctctctctctttgtgtgtgtgggttaaagctgctttctgaagttaagactttgtcctttattgtcacacagtttaggtgtttggagactactattaccagcatggcaaagtggcctacagcactgaccgtggagccagatttggttcaactcccaagtttataacctactagctgtgtgactttgtgcaagttactgagcctctctgggccttggtttcctgatgtgtaatagactctccctcttgcatctgggctgccctattactgctttgaccaagagagtgtggcagaagtgacggcatttttattttaagcctagccttttagaggatggacagcttaggtcttggtctcttggaaccctgaactgccatgtaagaactccaaagattgctggagaggccaaagggtggggcagagttggaggtgcaaagctgagcccagtcttccccaatctttgccaaggctgtgttaacagcctgaaagccagctgagtgcctagttaatgccatgtgaagcagaagaatcacctagctgagctccgcctgagcttctgagtcacaaaatcgtgagatatttaagaatgattgttgtttcaaggcaccaggttttggggtaatatgttacatagcttacctagtaatagctaaccagaacaggtagtggtgtgaggttgtgcctagggccaacttcataatctgtggggcccagtacaaaataaaaaatggatcctggttcaaaaagcaaaataaaatggccattaaaggtattaaaatataaaaccttttttctcttctgttgtctctttcaagatgtcagtgtttttttaaatttgctattgaatgtcattctaactaaataaaaatagaaattataaattattaatacggactttaccatttatctttacatagaatttgttatgccagttttaaatgtaaacataaaaacattggactcgtatgcggaatcaccaaaattacacaatttgcactttgtagttcttatgtgcttatatagttcattctttacgagaacagtggtgatgctgcacaaaacaaactcagtcatttctatttcacttcttgctatgtgcacaagcaccagcaccctctcagcaccagcagtctgcaggcagagtctgccattaaaggggtcgtgactaccttgggaaatacactgtggtccattaaaggggtcgtgactaccttgggaaatacactgtggtccagagcacaccaggcaccaggaatcgtgaccttttatctggatgcaggaaagagaaatgatctttgaggtccagggtgcatattggagtggcgtaataggagctagggggagagaagttatcatccttcttgtgggtgttaaagaaacatccaaattaggatggcagtcacgtgtatatttcacattccgcggctattttcatggccttactgggaaatgtgcctgggaattagattttcttatacacgtgtcaagccctgggagtgttatttgaaagcgtgctatttctttatgaaatttaatacttttgtccttggaaaatgtctgagatattgctgaccaaggatgtttttagtatacagctgataacactgttattgttgtactctgatacatctcgatagcaagccaaattaacatgacattctgcacctttacgatctaccatctaactttcctagataaattctgagaaataaaaataaaattctaagtcccctaactaactgaatggactccctctttgtccaaggagcctcagagaagccttaaaaactgagttgccagccatgccaggcacacaggaggtgggacacgccttgttatgccacctcccttactgccatcaatcttccttctctaacagacagaaaccagctcttttgaaagactcgcttcacctctgatttacacaacaactgactggcattccttcctgataaaagaccactggccgtagactggctctggcaggtattcacaggctgcagacaacatgcccctgtgtccttgctttcactttgtgacatacagagtgaaattataatgcaattaaatgtaagtcttcaccccaaatgaatatgagatgaatgtaacatggatgtttgcttgctatgaatgtgtgcacccccttcataattattctcagcccttcctataactattgaatatgtatacttagctagcccattcagcccaaatttctgtctcacctttccctctttcaaagtgcctgcttttggtttctaccagaagctatgcttcccagcctgcacagtgggcagcctgctggatgcaagcctttataagaaataacactctcctctccaaatttatgaatctcatgattctttagttaacaattacccaagccagatacttcttacttgatgaatatttcttaggtgaagagcagctgaactttaatacaaaattcacatatttatttgtctttaaaacactgtgtaattggctgggtgcagtggctcacacctgtaatctcagcactttgggaggctgaggtgggcagatcacctgaggtcaagagtttgagaccagcctgaccaacatagagaaatctcgtctctactaaaaatacaaaattagccgggtgtggtggtacatatctgtaatcccagctactcgggaggctgaggcaggagaatcgcttgaacccaggaggtggaggttgtggtgagtggagactgtgccattgcacgctagcctgggcaacaagagcgaaactccatctcaaaacaaacaaacaaacaaacaaaaaaacatggtctaatccattctacagcacatttctacaatcatcaaaagtggaagctcaatatggagaaacagagacatacctgcaaaaatttttgtatacagttttttcaagatctcagctttccaatataaaacatacatactttatgttgacaaaacaatgagaaattgtccttacatctctctgccaactgcatcttcttccaacatctattatatatgcaatgtctactgagcattatgcaggcctaagctctgggggtgcaggacaggcaaggtctctattttgcagaagcaaacagtttagcaggcagataggcaatcaacagtaaactgataaatatgtgatatgtaaaggcatgtttaataagagccctttcttttgaaacaggacacaattgcaggtgctggttattataccaaggctttgactagaataacattattaggtgaagctccagcaaagtcaacttgaaaagagtctctatggccaactgtaaaaagtaaagtagaggttcctcttcaaagactttcctccccgtctaattaggaataaatagtaacttctcttagaagcaaaatttattcaaagacctgtgctaacattcttaaatatctgctagccataataaaaaaatcaatatacaatttatgttcctagctcccacaatttagcctaaatatttgccctggcatgcttatactggtccaagcaagcattaggtcatagcctgttcctcttccttatttaaaagtgtttttacctttctcagccttccactagttacttcctccttcctttgttcccctctacctttgcctcttttaaaaagttctaagttgctagccaatcaggacaaatacagaatgcgagctcttgttccagccaatggaaactggacacaacagtagggtggacacgtcaggttataaatgaccctgtctcctttgttcagtgtactctcatggcaaaactgctggcgagtgtaccctttctgcaggaagtaaaagtggccttactaaataaattaaatttatgttcaagtgctatttctttatggcaccaaagaacaagcatttcaaaccaagtaattcctgctgcgctttatgtgaataatcaagccaagtgtaataagccaaaaacttattctgcacacaaattggtcttactataatttctctttagtagaaaaggagggctagagaatcagagaaaaattgtttcaagggaaaactgtaacacccgttactgaattccagccccgacttgttttagagtgcagatcgaattacatctcttcctacaataatcctctaaaaagtaccagcttataattttcttcatgtttttagttgttgccctaatgaaatagtttcctttttctgttctgacacacagattctgttttgattagcaagtttactaatgttatttatctcatgtagttttacttctgagaaaattagaatcatatattcataagactagagataatttgacaaagcctgtgaatctccctcatttggaatcccaccgggccccatctgtctttcattgcaaatgccctgctgctaaaactatacaagcaccctccctctaggcccagggactatcacgtaagacgtcagtgtgtgagattgcaagggccagttttgtgggatagaattagtttatagcctccaaatcacagatacctaaacagctggtaaaataagggactgtgcctcctgtgttattatgtatgtggcacccttttgtccatcctaaccgtaaagaatttcctgcttcccatagaattaaaagaaaattactgagaggatataaagacactttgtgacaaagcttgctgggtataatactcccagttatgagatttatgcatatatatatattttatttatttatttatttatttatttttgagacagagtctagctctgtcacccaggctggactgcaatggtacaatgttggctcactgcaacctctgcctcccaggttcaagcaattctcctcccaagtagctgggattacaggcactcaccaccatgcctggctaatttttgtatttttagtagagatggggtttcaccatgttggtcaggctggtcttgaactcctgacctcgtgatccacccacctcggcctccaaaagtgctgggattacaggcatgagccaccacgcccggcctatatatatatatttaacgtttattatcagccgtcttgggacaaattagtaaaatactgcaaaaatcattgaggcacagcaaaagtctctgaattccttagcttaaaaggctttaatagtgcttatgttttgtatagctaattgcaataagtctgtaactaaaaccaagatcacagtagctcaacatatagaattgagaggtagataagtcaatttgtaaccttgtctttggctttttgtttgtaggctcttgcattactgaaaaaatgttttaaggactagcgaacacctgtctacatccatccctgtctggcctagaacgtttacattggctatgcatcttttggctctaagtcccttggccataggcgtcccactgagggacaggagggacccagagcagacagccatgccactttggcaatgctatgggacacagtgaaagtttggtgtccattgatgttgcttctggcaaatcttggccagaagagggagaatgtataacaaatacaaaattctaagcccccaatcaggaccccttctctcagccaagggcattctaaagttaacctgaaaaactagttcaatccatgatggaagtaggggtttggtgggaagagggtgttgaacatgtctcacagctgaccagaattaacatcaacacagagacctgaagactggtagactctttaagtctgagaagaaacacttacaatctattctctttgaagccctgctacctggaggcttcatctgcatgataaaccttggcattcacaaacccttatcataacccagatttctttctattgattccaggtcttaagatattaactcccccaaccatttgccaatcagaaaatctttgaatctgcttatgacctggaagcccctgcttttgagactgaaccaatgtacatcttaaatgtattgattaatgtcttaggtttccctaaatgtataaaaccaccttgggcacaagtcctcaggatgtcctgagggctgtgtcatggaccattggttgcccatatttagctcataataaaatattaaatattttacagagtttgactctttttgtttggattggtaaccatcactgtgatcaagacatagagaatttccatcatctaagaaattgtccccttgcagccagtccccaatcccctagagcctattaaaaaatacaaaaaaaaaaaaacaaaaaaacttaaccaagtgtggtggcacatgcctgtagtcccagctacttgggaggctgaggtgggagaatagcttgaacctggaaggcagaggttgcagtgaactgagaccacgccattgcactccagcctggctgacagtgagactctgtctcaaaaaaaaaaaaaaattgatttctgtcatctgagattcgttttctctgttcttgaactttatttaaatgagatccttacatttatgtagtttttttttacgtctcccaaggctctgtcattcacatttatgtactcttgtgtgtccagtttcatctgctcaacttcatggttttaagattcagccatgctgtttatttattttttgttgattgtgataactgtgacttataataagaaatacactgtatttggtcttgtccctgttttctggcgtacagctcctatctgccttggaatctccaaaatggtaaatgcctttttgtatgctaaggagatgactgatgggggatggggagctcctagatagcctcaggatggggctggttgccatgggaaccaatcatgtgattagcagcttggaactctcagccccaagtggacttctggggagaagagtggggctgaagtctgacttgatcaccaagggcccatacattaatcaattatgcgtatgtaatgaaacattacaatgaaacattcacaaaaacccaaaaagacaagacttggagtttctgaattggtgaacaatggagagtggtgccccaggagtggcaatggaagctctgcgcttcttctcacatacattgcactatgcatctcttccatctgagtatttatctgtatcctttctagtatcctccataataaatgggtaaatgtgagtaaagtgttcccctgagttctgtcagctgtcctagcaaattatctaacctgaggagggggaatccttatatatttatttatttatttatttatttatttatttttgagacagagtctccctctgtcaccaggctggagtgcagtggcgcgatctcggttcactgctacctccgcctcctgggttcaagtgattctcctgcctcagcttcccgagtagctgggactacaggcatgcgccaccacgcccagctaattttgtgtgtgtgtgtaatttagtagagacagggtttcaccatgttggccaggatggtctccatctcctgacctcgtgatctgcccgcctctgtctcccaaagtgctgggattacaggcatgagccaccgcacccggctgaaaatcctgatttataactggctagaagtgcaggtcacaacctggggcttgggtctggcatctaaacggggaagagttttgtgacactaagccctcaacctctgtgatctgatgctatctccaggtagatagtatcggattaaaactgagtggaaggacaccccgctgtcctttgatgaccagaagtgttctgtactgagtatggtaggagaaaaactgttcgtttgtttttttcaactgtaattatacagagatatatatttatttgtttgttgttctgttgatggatatttgagctatgtctagttttttttttttctgttttgaatagggctgctatgaatattcttgtgtgagtcttttttgtggacttacattttaattcctcttggataagttcctaggatctaagagtagaattcctgagttatagagcagatggctgtctgggaaaatgccaagaaggttccaaaggggttgtatcattttgtgtacaagatttgtgcagtgtatgagagctccagttgcttcacatccttgccgacacttgatgttatctgactatcttttagtgaggggatggtgatatctcactgtggtcttagttgtcctgatgaccaatgatgttgaacatatttttatgtgcttatgaactcttttctgttattttttatgaagtgtttgtccaatattttgcccattaaaaattagattgtcttttgattattaatttgtagaactataaaagatatattctggattgaagtcatttgtctgatacatatttggcaaatattttctcctaatctactgctacctttttcattttcttatcattgtcttttgataagcagaagttaattttgattaaatgaaatggaacaattttcttatttttagatgagtgctgttttttaccagcctgagaacactttgcctaccacattagatattctcttattattttgagaaattttattgcttttatgtgtaatagaactctgatgcatcttgaattaattttttgtatagtgtaaaataggaagtgagttattaattttctacacaaatatccagttgtttcagcactatttcttgaaaggactttccttttccctttttcattgctttgatgcttttgtcaaaaatcttgtaattgtatacatgtgggtctacttctggaatttctattctgtttaattatctattcatccttacaccaataccatactgtcttgattaccatactacattaagacttgaaattaggtatttatttccctattttatttttcaagactgtttgggttattgtaggtctttttcatttccatataaatattaaaaaattagcttgttaatttctacaaacaagccctctttggattttggttggtattgtattgaatatataggtaaatttggggagaaatgatactttaacaatagtgaatctttccatctatgaacatagtataactctccattaatttaggtcctttttaatttcttttagtgatgttttatagttttcagtgtacaggtcttacacatctttacttatttctaagtattttatattattataaaatggtatgtggtttttttgtaagtttcatttaccattttttattgatattatataagtatgcaattgaaatttatatatttacttcgtatcctgagaccttagtaagttcacttttgtgttatagtggtttctttgtaaattccttagttttttttatgtaaacagtcctgtcatctgcaaatggaggaagttttattttccttttccagctttatattttttatttaattatttatttttcttgccttatagcaatgcctagaacttccagtacaaccttgagtagaactggtggatgtgaacatttctacctcctttttcatcttagggaaaagtgttcatgtcaccatcagtatgacacaggctataagttttctatagatgctccttattgggttgataaagtatcctatttccttattgttaagtgcaatttctccaagagtctttgaggtctcttttcagttgaaggacttttaaaatgccaataaattcaaaaagcattatttcacaaacagtgctaattatgttctgttctctaagcatcaactcatttaaatctgaaataaggtcagggtgctattctttacattttctggcagaggaaactgaggcacaggttggcagaaaaggttctcaagatcagacatctaggaagtggcagagccagacagtctggctcctgagatcataggctaggctgcccctatatccttacgcacgtggttactgtaaatcacttctgccatcacttgaccatctgaaagtagcagatgctactgaaaaacaccttctttttcggggtggggaagggatgactgctgagggttttagtaggagtatatttctacagcatggttacagcatcctacattgcagaaatgtaagttgacctaaactatgtattcatacatgtgatttctcttttatttcctcagaatattaaaaaaatgaggatactgattttattcctcaaaagaagtttaagtcttgcttttagttagtagctacctccatagctttccataaaatatatattttccttaactcaagagataagaaagcaactgtcttcatgacccaaagcagtatcttttcaaacgttgtatttggcaagataaacatatttagtttttataatctctacagtgtatgttctttgcgcttttccagtataatactatatattttatatacagcaacagaaattggcatgcatatttttatatgcatcaatatgtgtatgtgaatttatacatatactctgtccatacgtgtatttcgtttaggtgtgaaatagtaacaatggctcctatttcctcagtgtccactttgtgtaggcaaccaggggctttatattttctgtctttaattcttacaaaaattttgcaaaataagtattgtcactcgcatgatccaatgagaatttggagacaggaaagattaatcactccattgaaggaataccggtagtaagtagtgaagctgggattatttctggaatttcaatccaaacccattagtggtggcgatttgaatgattcttgcacaatggccctagtgctgtgtggctgtccagaaggaaggacacaggaaggacaagcgctggtgttgaggcaacgtgtgggcaacccttgctagcacatgtgttgtttggtggcatgaggttctcagttaatatgaaccacacctgctcaagcttgtttactggaggcactgctccctcagcaggatctaatgggaatgccctcatttggttttggtcacagtcctgagagtgtgacaaaccacataaaaggggaaccaggcctcctaccaggtgcccaagggtgttgcagaccagggccacctcttttcttcgatgtgagtgctgagaagacttgcttagcatgtgctgctcaaaaaatacttgggagtgaatgaatagaaaaatggacaaatggacttttctatggttcagtcattaatagcccctgccctcgagcctaccgccccagcccagctgctcatggcctatggaatttcctcctcactttgacagttgcactagcttcacatggccttttgggaatagcacctgtgctaccctccaggtgaactgctctgtagggggcaaatgtgagcaaagcgttaggcccagcccacagggaatgtttccttgtgtggggcagtggggtaggccaggcgcagtgtccaggacacatgtccactgagatgggttgtgactgggggatggagctaaagatgctcatgaaagcccaggatgccttggggacagtgggaggtttggcctgggatgactcccctcctcatccctaggcagacatgtgactttgggtccctatgtcaagtcctgagagttttcagtttctgcatctgcaaggaggaagttggagcaataataaccaacatttgttagaacacgaagtgtcacatactctgcttacaacttgatgtgcattttattctttaatctttggataagtggccccagggattatcgcatctcacatatgagaaactgatgcttagaggggttgacaacttgcccaagatggcacagctagtaccagcacaacgtgagcctgactccaaacccacacttcctatgtgaccctcaccatcccgatagttccaagtgcacttctgacctcctgattttgcccctggagagtgagagactttgcaactgtaacaacctcacttcaccttttatgcaaatctcatgtataattttcataaactttatttttttaaaatgtaattccccagaggccttccctacctgacttggccttggatgggcagcagagggcaatgtagtctcagggaggcaccctcccttcccctgggctgggaactgtgaaaatctaaccactgctagcaaaaaccagtctcagctggaaatggtctaatcttcttggaggggatgttggagaatacatagcaatagattcagatgaaatcctgtctcagtaggcacacttagaatattgttccttggatggcattagaaagggaatctttttttttttttttgtaatatagagttctcattttattccatgcatgaaaagaagagataaaggttttgtgcttttcctcgcctctattaatagaagttattaacatgcctataatagaaaccatttcaccttcgctggaactgatgatgatgcttcatgatagcacagtggtgccctgttgccaagtattagatatggtccaatgtctcaaaaattaccagtcaaacggatttgtgagtgtcacaggttgtttttaagatctttataattattatttttagacttggtatcttttatatccatacactgctaggattcagatctgaaagtcagattgccctaataaactagtaggggctccttgggtgacaaagccactctgacagtgacttcattggctgttcattggccacataccctcgcctggttctctgaagagacatcacatcgcaggatgtgatgaacactagtttttattttcttagcaatatttcattaattcttggtgtgtcgtagtgaataaattactgtcaacatcttttgagcacccaacatgccagagcatttctaaacaaaggcaattgacaaaagatgtagaatacaaatgtttgagcgcttaagggctgggtgctttttaagtgctttatctgtatgactgtgttatgtcctcacaacagccctacaggtattatcatcatccccgttttacagatgggaaaactcacccagaggtgctacggaacttgcgcaagatcacagagctatgagagcagagcagggaagcagccccggatgggcggatttcaaagtctgcactctccattcctactccttcctgcttctcagtgtcagcaagagcaaatctcatgagctctagagcatcctggcaaccttctgggagggatgctctttaccttgatctatctatgttgggttccagaatcttctccctaaatgtaaatgtaacaggaactgttggtgactcactcacacccctctggcctggggggttctatctgagttgcaacttcttctttgcctgaggacattctcctaagcctcaggaggcctctctgcccatgtccagggtggtttgagtgctagggaattaatagccctggcagccctccaccaatgactgacaggccggtgtctgaatgtcccagctccctcatccttcaggaagaagcacagatttttctgcagtttccttgtgctccagcggctcacaaatgcgctgccttcccttcctggtctcaccttcccctcctggtcccatgtccctgctcccttgctggggtaccttgcacctgccaaataaattctttctactgggatctcaaatctgcgtctgcttctgaaaaagccaaggtagaagggatgaaagtgtccacatttaacagtaacttgggacttcctgaagatatccaaggattttttgggaaagactgaatttacattctgaaatgagagctggcatcagttaaatgaacatactaattaaaaagctccccttggcagggagctggttcttccttcttgtcatgatggttaggggagtggggtctgggtcgcctcttctcgtgacctaagtgctttgtgatcacttacatggcttgcccacttccctcttcagtgcctggttctggatcctggtagcaccttcatctgtgcttgtggccaggaatgggcattgctgctacagccatggccccaccctgcacacatggatctaccttctcttctttgtggcccaccttcctggctcagggacgctgcttctgcttgaattccaaatggaaaatggatgctccccttggagactgcttttctgtgtagcagagagcacattgtttatactaacagtaaatccatggattctgtcttctaataacaggttggttatttacaatgtgccaggcattattagaagtgctttgcttatattaattagattgtcataaaactctgtgaagtatgtgctattattttcttcattttacagataaactgagggacagagaattcaaacaacttggcccaagctatacattgagtaaatggtactatcttgtgtcagatccagatttgtaatggaggaaaccaaaatatttcacctccaaatatccttctttgacatattttgaggtggctgttcagagggcctgcaaacagaggtagccttgcaaagctgtcctttgcggggagatttgcatctgtacagaatcagcatggtgcagccaggttttctctgaggctaacccttgtccagatcaagaaaagattaacagagtctgacaccttaaatttctgaaataaacatttaccatctattctctctgaggactgctacctgtaaggtttcacctgtataataagaccacatttgcaagccagacctcctcttctcttcctcccataacctgccttgacatcataacctgatttaccaccgcaaccagtttttggccgtactccaagcccacattttttctgtaaccttaagctgtgtataggctggatgtggtgactcctgcctataatcccagcactttgggaggccaaggcaggaggatcacttgaggccaggagttcaagttcaaggcaacatagcgagacccccatctctacaaaaagtgaaaagaattagccagccatggtggcacaggcctacagttccagctactcaggaggctgaggcgggattgcttgaaggactgcttgagcccaggagtttgaggctacagtaaccatgatcctgccattgcactacagcctgggcaagagagtgagaccctatatcaaaagcctttaaaaagatagtgtaaaagtctcaacctccttaccatttcttggagatctttgtaagattcctgtgcacattaataaatatgtgtgccttttctccaattaatctgtctcttgtcagttgattttcagtgacccttccaagggcaaagaggaagtttccccttggcacccacaggaacaactgcccctcactaccttctgcttcacagtttcaaatgactggccactcaccaaaaggcagaagaggttcatgagttcctctttttctcatttgcacttgacctctttctcataacacacatccagccatgtcttctacatatttttttccccagtaaaacatctgtgactcatagttgtaaaaaatcaaatgaaatagtaaaaatgttttaaaagtacatctcagggctgcttcccttagaggctgctgctgcgcaacactaaaggacatacatgaaggtgtgagagagcagcgtgacatgtgtcccatggtccccatggtttatacacttggttttccagaaagcatctctggtcagcacagatgcagaatttctggttcagtgcagttggctgagcacttgtgcttaatgccccacccacaagagaccccattgaaaacgattttgaaagagggaacaaaatgtcactgcagacaccactggaggtgaggtggcaggtgggatttcacttcgggccagattgaagactggttgaaacagggaagaggcatgcctaccagcaccatgatggtttacgactgccgtgccaacacctggaagttaccacttctgttctagaaatttctgagtaacccaccccttaatttgcatgtaattaaaagtatgtataaatataactggagaactgcctctgaactgctactcaaacacacggcctttgaggtatcctggttctgcagaggcagtcacagagctgtaacactgttgccccaataaaagccatttttttctaccaccagctcattcttgaaacctttcctgagtgaagccaacaattttcccaggctaagccccagttttgggactggcctgccctgcatcaagtggcattcctagctgctctcacagaaggcctatgccctccctggagcctcctcagtgccgccgttctgaggagggtcctgccagttctctaacaaaggattccatcccaaggtcatcaggcacctctcccccttatccagctagctccagcctatacttcttactgctcaaaagagtaagcccaaccaatacctccagaagtggaccccatatcagcccctaaaagtcaaacctgtgtcccttgcaagaagtagctgatgaaaattggggagcacttagagtacatgtgctattttctatgtctgatttggctgtatttaacaaaaaaaatttggctagttttcagaggatccagaaaagtttatagaggagttttttaagttgaccatgttctttaatttaacttgtcatgacttgcaagtattatcatttacttgctgtgctatggaagaaatgcagtgggaaacgggtgtggtttagccaatgagttatgacaaggttagagaaataactcagggaaaatatgaaagtcccactctgtttcagggtcgtttggttgaggcactcaagaaatatactaacacagatccagactcctcagaaaggcaggctctcctgggtatgcattttattactcaatcttcccctgacatcaggaaaatgctacaaaaagcagcagcaagggggtctcacacccccataatccaactcctaaagacggtttttggagttaagaacaaaagtgacaaaggagaagaagaggcaaaaccataagaaatagccaaaaagtgcaattattagcataagctttaagccctcttcctcctcagggttacccatcccaagaaagtgtcacaagatcagtgtctggaatgcccagatgagagccccaaactgactggcccctgggtcagaatcaatgtgcctactatgaacaaaagggctgttgacaatgagactgtcctaactgtccctactgacagagagaaaaaactctccatcaattctagagctaaccttcttccactagccccaatgagctgctttgctcaagtaagtttactagggatcttagatcctttacctgacaaacagcttcctgcagtggcagactagaggctgcctgaacatttttcttcagtgttccactgctgggtgagctctccagcagctcagagactcaggtctccccttcagtaacacagtttgccccctcctttccttattggctgctacaggatccccttccctgcctcttcctgtcttccatgcctattggggcaaataaagtttggtcaggtagacaggtcccagttttgtaaataacttggatcctgttatcctgcataggccctttgtttgaagtgtttgtgtgtatagacaggtattgtggcatgtcctgtgtctagcatgctatcagattggcttataaataaaagagcaagaataaattaaacatgtaagtctagtctgaacttgttagtttgaaaataatatagtgccttttacaatttaactttaaggtaaaccactgttgtttgtaggttttgaactggttaaaatggctttaaatagcaagctttttgtgtagttgaaaaccttaaaattgtgaaatggttcttatctacagaatgccaatgtctgttgggaagttcaggatttcttgcctcctaggtttatataaaatgtgccagggaaaatatattctttattgggaaaaggagtaatttttgtcaaattcagaagtcattgaaggtgaggttcaaattatgaagcaaccatgagtggaaaaaaaagagatagaaagaaatctctagataaaaaatgtatttttttttgcaaggaaggatataaagaaagagtaattttgtataaaaagatattctacagtaaactcttgtcctagaggaaaatgaatggttatttaagaaagaggtagtataggacaagtcaaaatgtccaagcatgtggtagatggtatatgtaagttgtgataaggttcataaaggggaatttatgaaaggaattttatgtgtgattaagctagctgtaattaaaagaaaattgtatataatagactttctaaaaatagtctccatgtcaaaccaaattttcttacagtattaatttgctaaattacccaaaattttgcttttcgatttcatattctatttcttttaaaagcctcttgcttctcagagtcatataactgtgtcctttagccttttcatcagctcctgtgacattttctcttctggttctgagtgttattgtggcctgatactaaagtgttttgtctcagaggtctataaaagctgtgtttttctccaatataacttgattctatactcttggtttttcttgatgtttctaaattttcagtgtaaccagaaaactttctcagttcccctgctacactcataatcttaaatacacttttcctgcatctgattaaattcaagtattatgtttttcttcatcaaactcaactttcaggttatttaagtggagttcccatatggagaggtaatcacagtgccaaggatatttaactttggataaataagtaactattgcttacaataacctgtagttccacactgatcaaatattttgggcctttaacccctttgacaaatgcccttagaattgaatcctagtttaaatctcttgcttgttgctggagtttatcaaagctataaaaattaatcactgcaatgttataaaatctttttacagcttccagtcaggtcatgaactccagtatcactacctccagccctctgacaagttccttatcaggtgctattaactaatccatgtgctgttaaattacagggcttttattcttgggtatgcatagctcatctagagatggcaccaattcctgccagtatctaatatcaaactcaagttaaccaaagccttgtctttaaacctgggcaaaggagacaatcaaagtaaactgctttcatgagacaagagaaaagcttgtattcatttaataatcttgcctctaactgaattaatataacttattctatgccttgacaccaaataatttaaatgtttagctacctgtgagctttctttattgtcattctcaaaactaggcagggcttatgaactttttgcttgaaacattgctaattctctgttttgttttacatctagaatttaaaatgatttaattccttcaggcctgggaactatagtggaataagtgggcatgaaagactgcaagggctgggttttgagggataaaattaattcagcccctccaaatcaaaaaaaggcacacagatgcctaaacaaaatgcttgtgtttggtatagctaattgctacaagtcaagattacagtagctcagtgcacagaatgtatagataagtcagttttaaaaccttatttttggcttttagtttttgactcttatagtgcttaaaatggttttaagtacctgcctacctctattcccaactggcctagaatgtttaattgactatgaatcttttgattctaagtttgttggccaaaggaaatcccccttccacacacacaagaaaattctaaaacaactaattcagtccatgacacaaaacaggggattggagacacctcactatgccccctttacaatttaggccaggtttgcaacaccctttaagaatatagaaataaagtaatgcctcctcccagaagacttagtcttactaaaaactgaagaagaaaaatcctccaagggattacaaccaaaacagaagggtgcttgccaagtgttgctgagtaccctactcatgttaaactccagggaataactagttgggtacacctgtccaggattaaacctatttcttttgcattttatgcaaggcataaaatgaggacaccatgatgacatctgtgaacctttaaaagacctccactacttacttaaaagaatcaacactcagccagaagtggtaatgtgatgctgggaatgggaacaggcatgttaatttttctctttttcccaactgcaatacattttttccattgctttggccaaccacgtcttcctgggaaacacctcttttgcagttgttgggtgtagaagccactctaaggcccaaccagataccatgctgtcactgttaattctgttggctctctcaattatcctgatccagtgtgggtgggaacataactctgtggtaagtatttcaaaaattatggcatcagggaatcatctttgtggttgctggatttttcatcaacatccccaggatagagagttccaccttatggtctatctggaaaatctcgcagtcatattcccagacctcctaactaaccatatgatcccaaagttcccagacccctacttgctttgtggaactctctcccacctaatggattccacctgaacctccccaaccactatcacctgcacctgggaagttgtgtatccatatctccagtacactaatgattctatcttttgcaccccctattgtgttaatgacgcaaaagcagaagtttccctgtgaagctctggtacagctctagttgccaagttcccaaggctgcagcaaggtaaatggaattccacttgtgagcaaggagaccatatatggtggcgtctcccagatcagaacatacaggggaagaacaactgcctaagctgggaaggtgggagtgctgcccacctctggaaaataaagattgctcaaccacctccacgggaacaggggaggaatatttccatagacccagtttggcagcaaaggataggtgtcataccctgaagggcctccatttgagccccaacagggctcatttttgtctgtggccatgaatgggaagaagtcacaccccataaccatgcccgactctccaaggagccacctgttcttttaggagtagctttcccttgtatatcaaagcttgaagcagaggtgaatgtatgttgaccacccttgcctcttcaggggtcacagtctataaccccataagacccaggaataccagaaaggagcaagcaggaggattaattctggcaggaatcagggcagcaataggactaatggcatccagggggtagctttgcctaccacgagtcaaccctaaagaacttgactgaaatcctagaatccttagccaccaacacaggtcaggcagtaaagggaattcaagagtccctagactgtttggcaaatgtagttctcaacaacagactagtattggattatttaccagctgaacaaagcaaagtctatgcagttattagtaaaacttactgcacatatattaacaactctgggcatgttgaggttaacattcaaaagatctatgagcaagctacctgattacatagatataactggggcagtgaacccaaatatatctggtccactattaaaattgccatcccaagtctcacctggtttttatcaatcctaggacctctgatagctgtcttgttattactaatctttggcccttgctactttaacctcttagtaaactttatgtcttctagattataacagttccaggtaaacacaatgctggcacaaggcttcaaacacattctgtctactgatacagagaataaaagcatcctgcctcttggccccctagataaggtatacagacatttttactcctctgatgccaggcagggcgtatgcccctaaaatcagcagaaagcagttacggaaaatgggccttcacctttctgcaaggagaagtatctaatctctgagcagggaatgaggtaagaggcaggaccagatgaaagacatctggtctttcatccagaccagatgaaagacatctggtctttcatccagaccagatgaaagacatctggtctttcatccagaccagatgaaagacatctggtctttcatccagaccagatgaaagacatctggtctttcatccagaccagatgaaagactggctggaacagtggctggaacagccactgaaagcatctcttcacaagacatgctcaccagtgccatggtggtttaccattgcaatggcaacacctggaagttactgcccaaagaaatttatgaataaaccacccctgaatttgcaagtaattaaaagcaggtataaatatgactgcaaaactgcttctgagctgctactctccaaacaccacctatggggtagccctgctttgcagcagcagtcatggagctgtgacactgctacctcaattaggctgttttctaccaccagctcactcttgaatttgttcgttagtgaagccaagaaacttcttggactaagccctaatcgtgggggctcacctgtcctgcatcagaagggcatcatcagctgcccagagaggttctctgagagcaaaacaaagttttacccagcagggactccaaaagatgacctcctctctttggatgttttactccagcaaaataaaagtgcaaacaaacacaggggggtgaggcaccccccacgatgcggggagtaagagccagcccctctcccccccggctcttaggacccccatcgcaggggggtgaggcaccccccgcgatgcggggagtaagagccagcccctctccccctctggctcttaggacccccatcgcaggggggtgaggcaccccccgcgatgcggggagtaagagccagcccctctcccccctcctggtttttaggatccgcggtggactcacagcctgtttaccatattgtgagtaatatcatctccccctctggagattatgaactttttcacagacgggtgtacaccctcggtgtacagacggtgtacaagcgtctgtattgggagtaatatcatcctcttcctccctgaatattaagaacagtattacaggggtgtttctactccctacgatatcgcgtatcatatcctcctctcccatgttgcaattagaaacaatatcagtaggggcgtgtccaccttctgtcgtattgaaagtaataccatcctcttccctccaagatcatgggaacaatatccctggggggtgtccactttctgtcatatatgtagtcatatcaccccctccatcttggaatattattaaggaccatctcacatgcgggtgtatacttcctgcgatatcgggagtaatatcaacctctcggcctctgaagattaggaagaatatcacagggtgggtgtacacctcctgctctattatggggagtcatatctatctattatggggagtaatatcatcctctccctttcaggatattaataacaatttcacaggctgggtgaacacagcctgtgatgctggaattattatcatcctgtccccctcagcatactaggaacaatatcacagaagaggtgtacactccctgcgatattgggagtaatatcatacgcttcttccgtggatgttaggagcaatatcaccgggtggctgtacattcattgctctgttggcagtcatgtcatactctacccgctgggtattaggatcggtgtcacagggtgagtgtacacctactgtgatatgaaaactaatatcatgctctccatccctgactattaggaacaatatcacaggtaggtgtacaccccctgtggtgttaggagtaataatattatgaattattaaacatcagtcttattaagaattatcaatggtaagattaatagtataatgtcattaatcattaatgcttattttcaagatatgattatgcatgattaaaataattaatattaatgtcacttttaatattagttattaattttaatactaattattgttttattaccatcacttatgattgaagtaacattaattaccgatatcattattttattattaatagtgatattgctattaattattaatagtaaccattaatattttaatccatactgttttactgtctctactgtaattattaatatcgatgattactattaattgttattgtttattaatattaataattaatgtaactgttcccgatatctgtgggggagatgatattactcccaatatcgcagaaagtgtacacccctctatgatgttactcctaatagccagggggtagaggatgacattattgaaaatatcgcagtgggagtacgtcccttcggtcatcttgttcctaatatcctgggtgggagcggatgatatgactcccaatatcgcagggggcggagacctcccccgtgatactgtccctaacatccaaaggtggagaggatgatatttcttccaattcgccgggggtgcacaccacccttgtgatatcgatcctaatactcaggcggcgagaggatgatattagtctgaatattgcaggaggtgtacactccctagggatattattcctaatatccagggacggagaggatgatatcactcccaatatagcagggggggaacaccccttctgtgacgttgctcctaaagggcagcaggggagaggaagatattacggccaatatcgcagggggtgtacaccctcttgtgacattcttccttatatcctgggagggagaggaagatactagcggcaatgtcgcaggggctgtacacacccactgtgatattgttccgaatatcccaagggggagaaaatgatgttacctccaatatcgcagggggtgtacatcctcctgtgatattgtttcttatattcagggggagaggataatattagtcccaatatcgcaggggttgtacacacctcctgcgatatggggagtaagagccagcccctctccgcccctggctcttaggagccccatcgcaggggggtgaggccccctccgtggtaaggggagtaagagccagcccctatccccccctggctcttaggactcccatggcaaggggatgagccccccgcgatgcggggagtcatatcacccccctctcccccgctggatatgacgatccacggtggtcacacagagtgttcacgttattgtcagtaatatcttcgtccctggaaattaccaactatgtcacagacgggtgcacatcctctgcacttttggagtaatagcatcctctttccccttgatattaagaacaatatcacaggagtgtttttacccctaggggcattccgtgtagtatcatcctctcccacgttgaaattaggaacaatatcactgggggcgtttccaccccgtgcgatattgaaagtaacatcatcctcttctctcctggatcatgggaaccatatcactggggtggtgtacactttctgcggtattgggagtaagatcatcctctccacctaggaatattaaggaccatatcacagtggggctgtacacaccctgtgctattaagaagaatattatcctcccctgccctgcacattggaaaaaatatcacagagtgggtgtacacctcctgcgatgggggggggggggggggtgatatcatcttctcttcttctggataatagcaacaatagtacacgggtttgtacactttctgtgatattgggagtaatatcaacctctccgcctttgaatattaagaacaatatcacagactggatgtacaccccctgcgatattgggagtcatatcagcctctcctctccatggatattaggaataatatcccaggatgggtatacacctcctgctgtatggggagtcatatcctcctctcccttcctggctactaggaacaatatcagagggtgggtgtacacagcctgcgatattgcgagtaatatcaccctctccccctccggatattaggaacaatgtcacagaaggggtgtgcacttcctgcgatactgggagtaatagcattctcttcttccgtgactattaggagcaaaattaccgggtggatgcacacccagtgctatattgggagtaacttcatactccaccccctggagattatactcggatcaatatcactggctgggtgtacacctactgcgatattgaacgtaatatcatgctctctccctccctggacattaggagcaatatcacaggtgggtgtacacccactgaggtattaggcttaatagtagtatgaattattcctcatttattattaacatgaatatcaatgaccgatattcatattaatattaagaaataattgctaataaaaatttttcagattaatattaatattaattattaggagctaatattactgttttctagtgaataagatcaatatcagttattaatatcgggcatcattaatcattaatattaatcatttattgttatcattagtatgactatttaatattaatcatcattattattggtattgattttaaaaattatattatcagttattaatattgataattattagtgtcaattaataactgagattattaattgcggtaagtcacattgcgccattccacccctccctcggcagctcgtttacgacccaaaacggggatacaaatgcccctgagagagcagcggtatactgggatagatgaggatggtcacgtggtggagaggcgtgtttttgggtaccagcccttcacctgcgtcgaccttctcaactggaaaaccaatacaccgccctataccaaaaagccacaagccctaattgatttgctccaaactgttatccagacccacaaccacacctgggctgattggcacctgttgctcatgttcctctttaacagcgaagaaaggcggagagtccccaagcagcaactaagtggctagaggaacatgcatcagctgattatcaaaacccccaagagtatgtaaggacccagttaccaggaaccgacccccagttggacccacatgaaagagaggatatgcaaaggctaaaccgagacagggaagctctcttggaaggattaatgaggggagctcagaaggccacaaatgttaaaaaggtctctgaggtcattcagggaaaagaagaaagtccagcacaattctacgagaggctgtgtgaggcctattgtatgtatactccctttgatcccgatagccctgaaatcagcgcatgattaacatggctttagtccgtcaaagcacagaagacatgagaagaaaactgcagaaacaggctgggcttgcagggatgaatacatcacaattactagaaatagctagccaggtgtttgtaagcagggatgcagtaagcagtaaggaaaacggcaaagagaatggaggtcaggcccagcaaaacaccgacctgtttgttagctgcagcaatcagagggccccccacccaaagaggcaagggaaggggggccctgggaaagaaactcagcttggctgtcagagtttgcagcgtaaccagtgtgcttattgtaaagaaataggacagcggaagaacaaatgccctcagctcaaaagaaaacaaggtgactcagagcaggagggcccggagaaggaggaaggggccctgctcaacctggcagaagggttattggcctgagggagaccgggctcaagtgtccccaaagagcctctggtcagaatgacagtcgggggtagagacattgattttcttgtagatagtggtgctgaacattcgctagtaaccgccccggtcgcccccttatccgaaacaactattgacgtcatcggagccacgggggtttcagcaaagcaggctttctgcttgcctcggacttgcactgtaggaggacataaagtcattcatcagttttggtacatgcctgactgtcccttgccctttttgggaagggacttgctcagcaagctgagagccactatctctttgacagagcatggctctttgctgctaaagttacccggaacaggagtcattatgacccttatggtcccccgagaggaggaatggagacttttcttaactgagctgggccaagagagaagaccagctctggctaagcggtggccaagagtacgggtggaagacaaccctccgggattggccagttaagactggggcccagccggttaggcaaaaacaggccctggtccccagagaagctcttcaaggtatccaggtccatctcaagcacctaagaacttttggaattattgttccttgtcagtctccatggaacactcccctcctgcctgttcccaagccacggaccaaggactaccggccggtacaggatttgcacttgcttaatcaagctacactgactttacgtccaacagtacctaacccatccacattgttggggttgctgccagctgaggacagctggttcacctgcttggacctgaaagatgctttctttcctatcagattagcccctgagaggcagaagctgtttgcctttcagtgggaagatccggagtcaggtgtcactactcagtacacttggactggacttccccaagggttcaagaactccccaccatcttcagggaggcattggcttgagacctccagagtttcccaccagagacctaggctgtgtgttgctccagtaggttaagacaccccacggcggtcgggtgcgccaagggaacagatgccctacacaggcacctggaggactatgggtattaggtgtccaagaagaaagctcagatctgcggacggcaggtaccttacttgggatttactatccgagaggggtcggaatgcagccctggatcagaaagaaagcaggtcatttgcaacctaccagagcctcagggcagaaggcaagtgagagaattcttaggagctgtggggttttgtagactgtggatcccaaactttgcagtattagccaagcctttgtatgaggtcacaaagggggcagggactgggaacttttggaatggggatcccaacaacaggaagtctttcatgagttaaaggaaaaccttctggcagccccagccttggggctacccgatctgacaaagcctcttccattgtatgtgtcagagagagaaaagatggcagctggacttttaacccaaactgtggggccctggctgaggccagtggcctacctctctaaacaactagatggggtttctaaaggatggtccccctgtttgagggccttggcagcaactgccctgctagtacaagaagctaataagctgactcttgggcaaaacctgaacataaaggccccccatgctgtggtgactttaatgaatactaaaggacatcattcgctaacgaatgccagactcatcaagcaccaaactttgctctgtgaaaatccctatataactattgaagtttgtaacaccctacaccctgccaccttgctcccggtaccagagagccctgtccagcctgattgtgtagaagtgttggactcagttgactctagcacacctgacctccgggaccagccttgcacatcagtagactgggaactatatgtggatgggagcagcttcttcaacccccaaggagagagagatgcagggtatgcagtggtaaccctggacactgttgttgaagccagattgttgccccaggccacttcagcccagaaagcggaactcattgctttcactcgggccttagaactcagtgaaggtgagactgtaaacatttacactgattcttggtatgtcttttaacccttcaagtgcatggagcatgatagaaagaaaagggcctattgaactctgggggaaaagacagaaaatatcaacaagaaatcttgcaattattaaaagcagtatggaaaccccacaaggtggcagtcatgcattgcagaggacaccagcgagcttccaccttgctgggtttggggaattccctcgctgactcagaggctcgaagaagcagcatttgcccccttctgggcatcagtgctccctcaagcacctgatcttggacctacttcttctaaagaagaaaaggactttctccaggtagagggaaggacaagtgatggagggaggatggattcagttaccagatgtgagaatagctgtgccacagttgctaggagctgcagttgtactggctgtgcaagaaaccacccatgtaggtcaggagtcactggaaaagttgttaggccggtatttctacatctcacatttgtcagcccttgccaaaatgctgaggcagcggtgagttacctgccgagagcataatgcgaggcaaggtccagccgttccgcccggcatacaagcttatggagcagtcccctttgaagatctccaggtagacttcacagagatgccaaagtgtggaggtaccaagtatttactagttcttgggcgtacctactctgggtgggtggaggcctatcaaacacaaactgagaaagctggtgaagtaaaccctgtgctccttcgagatctgattcctagatttcgactgtccttacggatcagctcagataacaagcctgcgtttttggctgccttggtacagaagacggcaaaggtattggggatcacacggaaactgcgtgccgcctcccagcctcagagttccagaaaggtggagcggatgaatcggagtatcaaaaatagtactattgtcttccccgctggatatttaaaacaacaccacaaggggcgtcaaaccacctgctaaatttgagggaatgttatcctctcccccgctcccctggccccggatattagagacaataacacaggggtcatgtacacccactgctttattgggagtaatatcatcctctcccttcttggatattaggaacaatatcacactgtgcatgtacgcctgtcgcgaaattcaatggaatgtcatcctgtgcctccctggatatgacaaacaatatcacgggggatgtacaacttctgagatattgggagtgatatcatcctctcccctctggaagttagagacaatatcacaggggtagtgtacaccctctgggatgttgggactaatatcatcctcccacccactggatattaaaaaccatatcacaaggggtgtgtacacacacttcgatattggtattaataccatcctctccctctttggatattcgatgccatatttcaggtggggtatacaccacctgcaatattggaagtaatatgattttctcccgcccggatatcagaaacaatatcacaggggggtgtcaacaacccctgtgatatttggaggaatatcatcgtctcccctcatgaatattaagaacaatatcataggggtgggtggtgtacaccccctttcatatttgatatcatcctcttcccccctggatattaggaaccatatcaggatgtacagaccctgtgacctttgctgtcatataattgtctctcccctagatattaggaaaaatgtcactggggatgtgaacagccttgcaatattgggagtaatatcatcctctctccccttgcatattgggaacaacatcacaggtggggtgtactgcctctgcgatattgggagtaaaattttcctctcttcccctggacattaggaagggtatcagagggggagggtgtacattccctgccatattcaaagtaaccttatcctctccctcccagggtattcagaacaataggacaggaggggtgtacaccccctgcgatattgagagtcatatcatcctctttcgctctggatattaggaacaatgtcacagggttgtgtacaccccctgcggtactgggagtaatatcatcctctcttcctgtggatattaggaagagtatcacagggctgtgtaaaccccctgcggtactgggagtaatatcatcctctctccctctggatattaggatgattttcacaggggtgtgtacaccccctgcgatattgggagtaatatcatcctctccacccaggaaatgactaacaaggtcatgggggagtgtacttcccctgcgatattgggagtaatgtcatcctccccaaacctggatgtttgcaacaagatcacagagtgggtgtacacaccctgcgacattggaagtaatatgatcctctccccaactgggtattgggaaagatatcacagcgcgggtatacatttcctatgctgttgggagtaatatcattctttccctttctggatatgaggaagaatatcacaggggtgctgtacaattacttcgatattgggagtaatatcatcctctactttcctggatattgggcacaaaaacacagaagggtgtacgacccctgcgatattgggagtaatagcatactctctttccctggatgttagaaaacaatatcatcagggctgaacaccccccgcgataatgggagtcatatttattctttcacaggccatttggaccaatatcacagggggtgtttacaaacaggggtagtgtacaccccctgtgatattgggagtaacatcattctctccacctccagatattaagaacaatatccccgcgggaggcggtacacccccagtgatattgggcataatgtcatcctctccttccctggatattaggaacaatatcacagggtgtacacccactgtattattaggaatgatatctctgtaggatattacaattagtatcacagggtgtgcagccactgtgatattaggagcaacatctttctacgatattacagacaatatcacagggtgtacgcccactctgatgtcaggagcaatgtctccctaggatatccaaaatcataccacagggtgtacaatctctgccttccaggttctaagggattctcctgcttcggcctcctgagcagctagggttacccgccaccacgcctggctaatttttttttttattttcactagagatggggtttcaccacgtcggccaggctggtctggaactcctgacctcaggtgatccgtcggcctcggccacccaaagtgctgggattacaggtgtgagccatggcacttggccaagagttatatattaaattaatgtggaaacacagctcccatatttgagtgtgcatgtacttttatgaataaatgatgtcagaaaacctaaggatgataataaatatgaaaagtaagtggcatgttaaaaggtcttccgattaagaactctaaggttctattttgtttttagataatgcggtcctagctcttgtatcatccttttacatattctacatcaaaggaatttgtcgcacggtgtcagaataaaacagagtgtatttcactgcttcttaatttctttcaattagactgagatctttttcttaaagagagaagagcatcttcattgcattttattttttctgaaaagagtaggccgtattttactgagatcatggatttgttgtatattatgttttggacttctaaaattcttcagtggattttctctaaagtagtatgtacagaaggagttgaatagcaaaaaagtaaatcatgtaataattctgagacttttgggcttgtcacaactgagaaatattgctggcggtgtatggtcctcaagtgtgaaaatgttccttgtgaattgcttgcatccaaaatatacacacagcattaagggctggtttttatcttttatttttccaatcctcttttcttcccaaggtgtccaagtcacacagagccacggcatctcacaggtgtctgagaattcctcctcctgggactctcagaggatccagaactgcagcctgtcctcgctgggctgtccccatccatgtatctggtcacagtgctgaggaacctgctcgtcatcctggctgtcagctctgactcccacctccacacccccatgtacttcttcctctccaacccgtgctgggctgacatcggtttcacttcggccacggttcccaagatgactgtggacatgcagtcacatatcagagtcatctcttatgcgagctgcctgacacggatgtctttcttggtcctttttgcatgtatagaagacatgctcctgactgtgatggcctaggactgctttgtagccatctgtcgccctctgcactacgcagtcatcgtgaatcctcacctctgtgtcttcttagttttggtgtcctttttccttagcctgttggattcccagctgcacagttagattgttacaattcaccttcttcaagaatgtggaaatctctcattttgtctgtgagccatctcaacttctcaaccttgcctgttctgacagcgtcatcaatagcatattcatgtatttcaatagtactatgtttggttttcttcccatttcagggatccttttgtcttactataaaattgttccctccattctaaggatttcatcgtcagatgggaagtataaagccttctccacctgtggctctcacctggcagttgtttgcttattttatggaacaggcattggcatgtacctgacttcagctgtggcaccaccccccaggaatggtgtggtggcgtcagtgatgtacgctgtggtcacccccatgctgaaccctttcatctacagcctgagaaacagggacattcaaagcgccctgtggaggctgcgcagcagaacagtcgaatctcatgatctgttccatcctttttcttgtgtgggtaagaaagggcaaccacatcaaatccctacatctgcaaatcctgacccttagtcacattatttttgtggcttgatggcttttattcctttctgcatttcctatgtggatattgttttcttcgttgtgcctttaactggagtgggtgaggattctgggatcctttgtttagcagaaacctcatgactgaatcctctatacctaggcggcctcctttagtttctgagcaataaccctgtcatccaggtggaatcacagccatctttttatatacatgaagtccgcacttcgttttggaattccctgaaaattgacttcatggaagcaatgtacagcaggtcctccaacaccattggtgcgttcaaagatgtgtagttataatgttggtgaggaataagtggtttcactatacctaatcttgcttaaaggtgaagtttccaagagactttcaaagacgataagtgaggacatactgtacatcaaattcatatcctcttcagagttcatgtggaatttctttataaactgcttctaaagaatctatttaggcaggttatgtgtagcgatccatgtcaccggtcctcaatcttggctttgagtcaaatcacctggggagcttacaaatgatgaggcctgggtctcattacctcagattctgatttccctgcacctatgtgagtatgtggattttttttttttttttaaagcaccagaggtggttgcaatgacgaagtttttagaggcatcaagctccaatgagtaagaacagatgttaattgtaatatgatttcttcaaatattatcttcaaatgcattgtccatcaacaccatacaaatgtttattatgctgttgtttcttaccatttagcattttctatttttttctttttcttttcttttcttttttttttttcgaggcagagtttcactcttgttgcccaggctggagtgcaatggcacggtctcggctcactgcaacctctgcctcccgtattcaagtgattctcctgtctcagccttccaagtagctgggattacaggcatgcactaccatgccggctaattttttttttttttttttttttttttttttggtatttttagtacagacagtggttctccgtattggtcaggctggtcttgaactcctgacctcaggtgatccgcccgcttccgcctcccaatgttctgggattacgggcatgagcgaccgcgcccagccactacttagcattttcattttacatttgttgaaattatagatttatacacactttgatgctgctttgttatacacttgcatatacataagacgggaaatagaaaagaataaaataggcacagtatccctgaagtttcacattccgagacatgttaaaaatatttgctttttagaaatttgtttcagttgagaaactgtggtatacacacacaatgaagtattattcagcctaaaaaggaataaacaaaatcctctccactgcagacaaaatggatgagatttcaggtctgtatattaagtgaaataagccaggcacagaatgagaaatattacatgtcctcacttatgtgtaggaagaaaaaagaaaatcttggccaggtgtggtggctcaggcctgtaatcccagcactttgggaggccgagtcgcatggatcacttgaggccaggagttcgagacccgcctggccaacatggtgaaaccccgtctctactaaaaacacaattagcccggcgtggtgatgcgtgcctgtagtctcagctactcggagggctgaggcccaagaagtgcttgaactcgggaggcggaggttgccgtgagcccagattgtgcctgtatactccaacctgggcaacagaaagagactccatcacacacctacacacaaaaggaatctcaggaaggtggaaagtataaaggtggttagcagacgctaggaagaaaaggggtgggatggggaatgaagagaagtggataattgggtcccaaaatacagaaagatggaataagtgagttctagtgtttgatagtacagtatgaaaattttagttcacaagaatttcttgcatgtttccagatgctttagtaagaagcttcctaactttctcattatgctggtttttcagctattctctttctgctctcgaaatcatgctggattttttgtttttggttttttgttttgagacagagtttcgctcttgttgcccaggctggagtgtaatggtgcaatcttgactcaccgcaacctctgcctcctgggttcaagcgattctcctgcctccatctcccgagcagctgggattacaggcatgccccagcacgcccagctaatgttgtatttgtagtagagatggggttttcttcctgtctgtcaggctggtcttgaactcctgacctcaggtgatctgcccgccttggcctcccaaagtgcttggattacaggtgtgagcaaccgtgcctggcccacgctgcatccttatctgttgtctgttgttgtttgtttgtttttcagcccagaaataacttctcacctatatgttcaaatgatttttcacatgagtgctaagaaagtccactggtggaaaagcagccttttcaagaaatggtgttggggaaacttgatttccacatgcagaagaatgaaggtggactctatgtcacaccaggtgcaaaaattaacacaaactggatcaaagacctaaccccaagtgctgaaagtataatatgcctaaaagaaaacataggccacactttcatgacatcagattgggcaatgctttctgggatatgacaccaaaagcataggcaacaaaagaaaattagattccttggattacatctaaatgacagacacttttgtgcatcagcaaacactgtgaactgagtgaaaggataacccatggattaggaaaaatatttgcaaatcatatctctgaaaagaggctgataggcatcgtatacaaagaacagctagaactgaacaacaagaaacccaaagcatcccattgacaatggtcagaagactcgagtagacgtgtccctaaagaagatatagcaatggccaataagcgtctaaaatgatgttcaaaatcactaatcataaggaagtgcaaatcaaaccaaaattgtgataccacacatttggatggatatgataaacaaacaagcattggtgaaactagagggaagtaggaatgctcaaatctgattggagggaatgtaaaaccgtgaaggaacagggaaaatagtatggcgtgtaccggaaaaagtagaaacaggattagcggatgttcccgcagttgcacttgtgggtacctgccaaaaagaattagaagccaggagtggaagagagattcgtacacccaaattcatagcagcagtattcacaacagccaaaatgtggaagcaacccaagggttcgtggacagatgaacgaaaaagcgcactgcagttcattcatgcgatggaagacttttcagccttaaaaaggcaggcacttctggccggtgcggtggctcacgcctgtaatcccagcatcttggaagactgaggtgggcggatcacctgagttcaggaattcaagaccagcctggccattcttggtgaaaccctgtctctactgaaaatgcaaaaaattagacgatcgtggtggcgtgtgcctatattcccagctactcgggaggctgaggcacaagaatcgctggaacccgggaggcggaggttgcagtgagcccagattgtgccactgcactccagcctgtgcgacagagtgagaccccatgtgaacacaaaaccaaaccaaaccaaaccaaaccaaaagaaaaaagaaaacatccaaacacccaaacagccagacaggcacttctgacacaggctgcaacacggatgaaccttgaagacattctcgtcagtgaaataaataaatcccaaaaggataaagacgaccaggctcagtggctcgcacctgtaaccccagaactttgggaggctgaggcaggcggatcactgaaggtcaggagttcaagaccagcctggccaatatggtgaaagctcgtctctattaaaaatacaacaattagctgggcgtggtggtgcatgcctgtaatcccagccactcaggagactgagacaaaagaatcgcttgaactcacgatgtggaggttgcagtcagctgagaccacgccactgcactccagcctgggcgacagggaaagactctgtctccaaaacaaacaaaccagaaaaattaaacacgctctgattccacttatatcacgtgtctagagtagttaaacttatacagttgcaaaatagaatggtggcccccaggggtgggcgagagagagaggaatggagagtttggttaatgggtgcaatttccattttcaaggataaaactgttctggagaggatggcggtgatggttgctaaacaatgtgaatgtacctaatgtgattaaactgtaaactgaaaaagagtggaaattgtaaatgtttatactggccattctatatgaaataatctacatttataatttttaacatttctacatggtatattttcccataataaaagatgaaaattaaagcacttggatcttgtaaaagaaaggaaagaagcgaataatacacacaaggtctctcctgattagaggaagagctccagagcttctatggacactcattttcctcttcttcttgcatgatgatgaggaaatccttagagcttggggaacttgggggactctggctaatgaggagctctgtgcttgagccccccacgccatagaatagtaaatactctgtgcctccagccctgcagtatgaggttgcagtcctgtgggctccacccccgtcacccgtatcaggaggctcatatctcaccctcccttctggccggccttgaggacggagtctgagcctccaatgtgcaccatgcagggaggacagtggacctgttctccgtggtcatggcccagcagaggggaagggcagttcagtgagtgctgagggaccgtcgggagccttgtttgtttcctcatcctcaggacaaacaggagagtgccgtgggcagatgggaggagaccaatgtgcaaactgtcagctcagcagactgtggagtttcagttcttggttgtggtggggggtctctctcaggaatcttcttcaaaattttgcttccctcccccactggttgtccttttcatagacatctcacccacgatagcagggaatgagtccctctaaactattcccttggaacaacaaaaagatgatgaaggtgatgatgaggataaagaggatgatgacagacaccatggcatcatgaacccttactgagggcttcctaaaggccaggctctgagctctgtgctctatgcagcttgtttcatttcatctgcttagtctcccagttattagtgcacatttcatgattattttacagactagaaaaggagcaacacattttcatataacttgcaccagatcatgaagtcaaaaaaggtgaagcccaatttgaaccaggcagtctaaggccagacacatggcatttggccagtcctctccctgcatccaacctgccctctcaaatccttgtcactcaggccgatgcccctgctcactgtgcccttccctttgggggttccttgtaggccacagctagaccagtgggtgccacaatcactgtgtcaagtatggaaagggcagctgagatgagatcacatcaaagattccagaaagaattggcacaggatcattcgggaggcatctctcccttgcccctgttcctggctttccttacagctctcgacttcctcaaaggagtcataaattcggggtttggcttccattcctattgaggaagctggaaaccatttcaaaaatgctcctcagatgtgcccatggttaagacctctgagctctgttgaaaacttttggaagctgggcgcggtggctcacgcctgtaatcccagcactttgggaggctgaggcaggtgaattacaaggtcaagtgttcgagaccagcctggccaacatggtgaaaccccgtctctcctaaaaagagaaaaatattagccgggcgtagtggctggcgcctgtcatctcagctactcggtaggctgaggcaagagaatagcttgaacctgggatgcggaggttgcagtgagccgagatcactccactgcactccagcctgggtgacagaacgagactccgtctcaaaaaaccaaagaaaagcaaaaacaaaaaagaacccacaacattttgagggttgggagaccatcaagcatagtgcccgggtcttagagtctggccattaattttcagtaccaccctttctacttatctgtatggcaaggggtgagacgtccatcctctgagactcagcactctcatctgagttgatttctagttgatccaatggaagtgagcgatgattaaaccgatcgtgggtgcccgctgcatgatctccatgtgatggatgcgtaaagtaaaggcaaagtgaattttagatacatttgttaatattttaagcttaaactccatacggttcaacggaaatatcccctgaccagaagttctggtttctctgcgttccagacaggacattttcttttgtccttatctcagtaagtactgagtattgtgagaggaacaagtgagtctcttttgtttctgattccccagagcctatatcttgcttggcacaaaggagatagcaaaagtaaacatctatgtgaattatcgaattgacacttccttggttcacaaaaattggctgtcatcagtgtgacagagagtgtgtttttggttttttgttttttgagacggagttttgctcttgttgcccaggctggagtgcagtggtgtaatctcggctcgctgtagcctctgcctctcaggttcaagccattctcctgcctcagcttcccgagtagctgggactgcaggcgcacgccgccatactgggcaaagtttttgtattttcagtagaggcggagtttcaccacgttggccgggatggtcttgatctcctgacctcgtgatccgccctcctcggcctcccaaaatgctgggatcagacgcatgagccaccgcggccggtcaaatgttctgatgaaaactctaagtccaccgaagctaaggacaggagttatagcttacattaattttaaaaccagacccaccgatttgagtaagcaattactctcttgaaggagaaaagtcagaaaacataatgatgaaatcactaggacctaactggcctgtggaactattttctgcttatgaactatcaactttaatttcatttccagatggcatggtctcagcagttatacagtgtttacagatgttctaaatcaagggaatttgtatcaatctattcgaataaaataaaatatttgagttcttaatttcctttaattaggataacctttttcttaaagtgaagagaatggttttattacatagtttcctttggtaaagataggctgtcttttctagcaattacgaatttgttatatatgatgatctggttcttggaacatccttgaatctagtgtctctggggcaggtgtgtagagcaagaagtgaataacacagaaatcaatgatgaaagcattagaagacagttgagtttgtcagaactgcaaaatattggtgactgtggattgctctgaaatctgaaaatattacttgtgatttgcttctatccaaaatgcagacatgatgctgggtgttggtttacttgtttccgatttctcaaccctcttttctaggcaaaaggtgtccaatctctacagacccacagaatctaatagatgtctctatattcctcctcctagaacctcagaggatccagaacggcagctggtccttgctgggctgttcctgtccatgtgcctggtcacggtgctggggaacctgctcatcatcctggccgtcagtcctgactcccacctccacacccccatgtacttcttcctctccaacctatccttgcctgacatcggtttcacctccaccacggtccccaagatgattgtggacatccgatctcacagcagagtcatctcctatgcaggctgcctgactcagacgtctctctttgccatttttggaggcatggaagagagacatgctcctgagtgtgatggcctatgaccagtttgtagccatctgtcaccctctatatcattcagccgtcatgaacccttgtttctgtggctttctagttttgttgacttttttttttttctcagtcttttagacgcccagctgcacaacttgattgccttacaaatgacctgcttcaaggatgtggaaattcctaatttcttctgtgacccttctccactcccccatcttgcatgttgtgacaccttcaccaataacataatcatgtatttccctgctgccatatttggttttcttcccatctcggggacccttttctcttactataaaattgtttcctccattctgagggtttcatcatcaggtgggaagtataaggccttctccacctgtgggtctcacctgtcggttgtttgctgattttatggaataggcattggagggtacctcagttcagatgtgtcatcttccccgagaaaggctgcggtggcctcagtgatgtacacggtggtcacccccatgctgaaccccttcatctacagcctgagaaacagggatattaaaagtgtcctgcggtggctgcacggcagctctgtctaatctcaacatcttcttatctgttgcattccttttgtagtgtgggttaaaaaaggcagcagggtcaaataagaatgatatcacagggtgaacacccactgtgatattaggagtaatacctccctaggatatagaatatactgtcacagagtatacacacatggggtacacccactgtgatattagaagcaatatctccctaaagtatgaggaaaaacatcacagggtgtgcacactttgtgatatgaggagtaatatttaccctggatattacgactattatcaagggtgtacacacacggggtacacgcactgtgatatcaggagttgtatctccctaggatattatgaatactatcacagggtatacactatgtgtgtacgtccactgtgatatttgaagtaatgtctctctatgagattataaataacatcaaagcctgtacacccctgtgacatattaggagtaacatccttctagggtattcagataacgtcacaacgtgtacaccttctgtgacgttttgtacactctttgtgacattaaaagaaacatccccctaggatattatgaataataacacaggaggggtacacacatggtgtacaccgcctgtgtcatcaggagtaacattcccctaggatattacgaataatatcacagcaggtgtacacacatggtgtacaccccatgtgacattcggaagagcatgcccctaggatattaggaatagtatcacgagtgttgaatacgcatctttaatgcgcaatgtcacacccggtgacattaaaaataacatcccccttggatattacgaataatatgacagggagtacaccccgtgtgacattccccgaggatataacgaataatatcagagggtgtacatgcattgcgaccttagtagtaacatctctttaggatattacaaataatatcacagggtgtacaggcattgtgacattagtagtaacatcccgctgggatatgacaagtcatatcatagggtgtacactgccgtgacaatagtagcaacattcccctagaatattaggaataatatcactggaggtacagcccctgtgatttatgagtagcatgtctatagaatattacaactcatatcactgtgtgactctgtgtacaccccgtgtgactttaggagtcacacatcactctgacttttaatttttctgtctccctccttcactttaagaactctagcactgaaggacttcaggaaataccacccctaacacctgccagtttcatatgctgattacttcaaactgagggctcatggggaagaacaaatgcagacaagggctttctctgagttccccttgtctgcttaaagacagacctcaattgtcatgaattccctccctgggaatcttatcaaccagagatgaactctccagggaagatgaataccatgcccacagtgactatcacatgttcttccaccagctgcttttattacctgagaggcttttatcttcataacaagacaaccttgactcaccatacaattcctcccctaaccctccatgacttgtgttgacaccacccccacccttgctagaaggcccacacccccatactttttttgtagttcagaatgctataaaaacatcaaccatggagtctcatatttggtgggactcccatgtgtatgtactgatatggttttgttctgtgtccctactcaaatctcatcttgaaccgtaatctgaattgtaatccccacatgttgcgggagggacctcgtggaggtgattagatcacaggagcatttcctccatgctgttcttatgatggtgagtgggttctcatgagagataatggttttataaagggcttttcccaccttcgctctgcacttctccttcctgctgaaagtgaagaaggtgcctttcttcccatttgccttaaccatgagtgtaagtttcctgaggctttcccagccatgtgaaactgtgagtcaattaaatgtctttcttttataaattacccagtcttgatagcagcacaagaatgaactaatacagtaacttagtaccaggagtggagtgctgatataataatactcgaaaatgtggaagtgactttggaactcaggaacaggcagagggtagaagagtttggagggctcagaagaagacacaaagatgtgggaaaatttgaaacttcctagagagttgttgaacagctttgaccaaaatgctgatagtgatatggacaattgttgggaacagtccccccaaaatctggccataactggccccaaaactggccataaacaaaatctctgcagcactgtgacatgttcatgatggccataatgcccacgctggaaggttgtggatttaccagaatgaggccaaggaacacctggcccacccagggcggaaaacatcttaaaggcattcttaaaccacaaacaatagcatgagcgatctgtgccttaaggacatgctcctgctgcagataactagccagacccatccctttattttggcccatcccttcatttcccatatggatactttcacttaatctaatatctatagaaacaatgctaatgactggcttgctgttaataaatacgtgggtaaatctctgtttggagctctcagctctgaaggctgtgaaacccctgatttcccacttcatgcttctacatttctgtgtgtgtatctttagttcctctagtgccactgggttagggtctccccgaccaagctggtctcagcagacaatggcatccagactgaggtggtctcagatggagatgagaaacttgttgggaaatggaataaaagtgactcttgctatgctttaatgaagagactggtggcattttgcccctgccctagagatctgtggaactttgaacttgagagacatgatttagggtatctgggggaagaaatttctaagtggcaaagtgttcaagagaaagcagagcataaaactttggaaaatttgcatcctgatgatgcgatagagaagaaaaacctattttctggggagaaattcaaactggctggagaaatttgcataagtaacaaggtaccaaatgttaattgccaagcagtgggaaaaatgtctccaggccatgtcacagaccttcatggcagccctttccatcacaggcctggagacctaggagggaaaaatgctattgtgggcccatcctcgggccctctttctctatgaagccttggaacatggtgtcctctatctcagctgcttcagcttcagccatggctaaaaggggccaacatacagctcaggctgttgatacagagggtgcaagccccaagccttggtgacttacatgtggttttgggcctgtgggtacacagaagtcaagaattgaggcttgggaacctccacctagatttcagaggatgtatggaaatgcctggatgtccaggcagaagtttgctgcagggacagagccctcatggagaacctctgctagggcagtgtagaagggcaaagtggagtcagagcctccacacagagtccccattggggcactgcatagtagagctgtgagaagagggccactgtccaccagaccccagaatggtagatccactgacagcttgcattgtgtgcctggaaaagcctcaggcagtcagcacaagcccatgaaagcagctgggaggggggctgtaccctgcaaagcaacaggggtggagatgcccaaggctgtgggaacccatgtccagataactcaagatatgtgcaaaaataattgcaacctaatatattgacataaggcagattaatggggaaaaagcattttaattatgtacatgtattagtccattctcatgctgctctaaagaactgcctgagactgggtaatttataaaggaaagaggtttaattgactcacagtttggcatggctgggaaggcctcaggaaacttaaatcatggctgaaagcaaaagggaagaaaggcttcttattcacatgccagcaggaagaagaagtgcagagcaaagggggaaaaagccctttataacaccaacagatctcaagagaactcactcactatcatgagaacagtatggaggaatcatcctcatgatctaatcaactcccatgaggtccctcccccaacacatggggattacaatttggattacaattcaagatgagatttgagtggggacacagagccaggccatatcattctgccccagcccctcccaaatctcatccttctcacagttcaaaacacaattatgccttcccaagagtcttccaaagtcttcattcatttcagcattaacccaaaagtccaagtccatagtctcatctgagactaaacaagtcccttctgcctgtgagcctgtaaaatcaaaagtaagttaattacttcctagatacaatgggggtagaggcatttggtaaatacacacattccaaatgggagaaattggccaaaacaaaggagctacaatgtccagaagttatcctatgtggtctgaaatggggaggaacccttagttccaggaatttcccacccccttccctgagagctcatgaataatctaacctttgtttagcatgtgatcaaaaaataaccataaaaattgcaaaccagcagacttcagggctgctctccctaaggagtagccacccttttattcctttactttcttaataaacttgcttttactttatcaacttgttcttgaattccttcctgcgtgaagccaaaaacccaggtggcctcccaggctaaaacccaattttggggatcaccctatgatccatcctggggcacaattcctctacaaccgtggactaaagaaaaaagttatctactcctaaaatacaatggtgggatatgcataggatagcagatagagatattctcacttaaaaagggagagaattgaaggtaaaatgagttactagttccaagtaatttcaaaatccaacctgacaaactccataggcttcaaaaccttggaataattatctgtggttcttgactctgtcctgagctcacagctccattctctgagtttgctggtcttccctctgtgaggtttttgttgttgttgttgtttgtttgttctttttttataatcacaaaaggcagcacatgcttgcagctgatcagtttgcttctgatccctgttttctgtctggagaagcataaaggtccatcagccatcttttagtctgctctttttgacttttttggtccatgatggctatatttctactgatattatagtctcaggaactttgtaggcctcttgtatgtctcaccaggattcacttcattccacagatcattcctaagtaatcccatatctatttttggcatctgctaactaaggggaatctataagttacaccctaaatttctcaaagattgaatattctgacatcctgctctttctctgatattagcaaaaggttgtgcagctacattccagactttttctccagagcattattttttaacagagaatctcttcactttagcatcatttgaaattttggaaagttgcaaatttcaccaattgtcatgacctggtctgactgctctccttccctgctttttaaaacagttcttccctcaatttctttcttttctttcatattttactgtatgcaacaagaagtaaccaggctttgtcttcgaaactttggaaatctcagataagtaaacaagtttgttgcttaaagtttcactttccacataattataggacacaatttagttgatctttctgtcactatacaacaaaaatccccttttctctagtttccaataatacattcctcacttccttctgcaccctccccagcagcacctttaacatccatatttctaccaccaatctgtttctgatgatgtaggtattctctagatgatgtatattttctccaccctacatcttacttccttctaagtcatccataacagagtcattaatgtttatatttatataggtctgtacaaggctgtctaacttttcctattacgttccttaaaattcttcctgcctagttctcaattccaaaattacttctacatttttaggaatttgttacggtagcactccacctccaggtactgaaatctaatagttgcctattgctgctgcaaaaattatttgtttattgctgctgcacatgcttagtggcttaaaagagcatgaatttattgtcttatggttttctaggccagaagtctgataaaagtctcacatgattaaaattaagatgttggcagagatgcattcctctctggagtctctaggggagaattcattttcctgctctccccagcttctagaggccacctgcttttattggctcattgcccattcttcatcctcaaagctgcatccttatcacatcaaatcactctaacgctgaccctcctgctgacctctttcctttctaaggatactggactcccctggatatttcaggataatctctctattttaaggtaggttgattagcaaacctaattctgctttgccatgcaatataacatattctcaggttccagggattaagatgtggccacttttttgcaggggtatggtgccttgatttgccttttgcataagatacataaagacaaaggcattacccacactcctgggagatatgaagttaaaaacaccaccttgggagtaaagctaaatgcgcccaccaccacacttggctacttttttgtatttttagtagagacagggtttcaccacgttggccaggctggtcccaaacctctgacctcaggagatccacccgccttggcctcccaaagtgcaaggattacaggtgtgagccaccgcacctggcccatgttaaccttttatagccacacccactttcctcctgtcccaatccttgacacctggcaaccactactatgtgctccatttctataattttttcattaccaggatgatatataaatggaatcatacagtgtgtaacattttgggattgatttttctcactcagcataattctctggagattcattgaggttgttatgtgtatcaacagttctttttatggctgagtaatattccatggtatggctatttcacagtttttaaatcattcacctactgaacaacatctgggttctttccagtttggggctattatacataaaactgctatgaacattcatatgcaggtttttgtgtggaaataagttttacttctctgggacagatggccaggagtaaagtttcttggtcacatggtaatgcatgcttagtttgttgttgttgttgttgttgttgttgttttgagatggagtctcactctgttgcccaggctggagtgcagtgacgcgatctcggttcgctgcaacctccacctcctgggttcaaggaattctcctgcctcagcctcccaagtagctgggactgcaggcacatgccgccatgcccagctgattttttgtattttagtagagatggggtttcaccgtgttgcccaggctgctctcgaactcctgagctcagacaatctgcctgcttcggcctcccaaagtgctgggattacaggcataagccactgcacctggcctgtgcatgcttagttttaaaagaaaatgccaaactggttttcagtgtggctcaacggctttacattcctaccagcaacgtgtgaaagatccagtttctctacacctttgccagcatttggtgttgccactacatcttattttagccattctgataggtatgtagtaacacctcattgtggctttaatttccttaacggttgatgatgctaattttttagcacgcttatttgtaatctgtgtatgcccctcagcaaaatgtctgtttatcatttggccattttctggttgtaatgtttgcattttttaactgttgagttttgagagtttttatacattcaaaatactaatcttttgttgaatatgtggcttttaaatacttcctcttattgtagcttgcctttcatcctttctaatgaggtctatggcagagtacaagattttaattttgacgaactccagtttatcaattttttttttatggatcatacttttggtcttaacttgaggagctctttgcccagcaacagatcttaaagattttctcctacttttttttggaaaaatttcatacttttacattttataatttaagtcatattcattttaagttaaattttacattatgtatgagacttggttctttttttttttttttttttttagacagagtttcactctgtcacccaggctggagtgtaagggcgcgatctcccctcaccgcaacctccacttcctgggttcaagtgattctcctgcctcagcctccagagtagctgggattacaggcatgtaccaccactcccagctaatttttttttttttttttgtatttttagagatggggtttcaccatgttggccaggctggtctcaaactcttgacctcaggtgatccacctgccttggcctcccaaagtgctgggattacaggcatgagccaccatgcctggccttagttgttttcacacttttgtgtaaaaaattagttggacatatttgcatggttttgtggattaggtattctagcatattgatctatctgtgttgatctctctgccaaaatctatatagccttgattagtgtggctataaagtgattgataattctctcatgttactctgtattttcaaaattgttttagttatttttgtttctttgtatttttcacataaaatttaaataatcttgtctatataacgaatgcagttggcattttgatagaaattgcattaaacttatgaatcaatttggggagaaatgacatctttactatgttgagtcttccaatgcatgaacacagtatgcctctttatttatttagatgttggttttctttcttcagtgttgcacagatttttgcataaaagttctatgttctatacaagttttgctagagttatactttagtatcgagacagccaagtataaaggggtctctgaagaacctcggaccagcccacagactgggagaatggggtgcagctgtgggaatttggcgccctttgcagctgggaggagcttggcctctcctgttccagggtggtatctgggattcaatctgtgaggtgggaaactggctagcaggactctcgctttcctgagagtcgctgtttccttttcttttcctttttgtccaataaatcccatttttctcacccttcaaactgtctgcaaacctaatctttcctgattgtgtgacaaggaccctaaggaaaaagtcctaccacagtatttattttagttttttttttttttttttttttagcaattataaatggcactgttcattgttagtatagggaaatacaattgattgttgtgcatttatctcttgtatcctgtgacttattgaatttgcttactatttctagtcattttttggtaagttcttggattttataaatagaaaattatgtcatctacaagtaaagaaagttttattttttcctttcttatctctatgtattttatttccttttctgtccttagtgcacagcctagaacttccagaagtaacaactgttgaaaaacagtgggaaagtggacgtccttaccttgtttctgatcttaggggaaaagtatgacatatttaatcactaagtataatgatatctgtaggcattttgtaggtgttctttatcaacttgaggaagttttcctctatccctgtttttctgaaagtttttcccatgaaatccaatgccttctctgtacgtattgatacaattatgtaatttttcttgttagtgttttaatatagtagattacactgattgatcccatgtctgtcccatcttcccagaaggagaaatccccaagcaggcagattttggcaaaattctcagtaaatttgaaaaatacattttctgatgagagattaaaactaatcttaccaatttccaaggagaacaatagatgaaggtcaaaatctacctcagtcttcaacatccaaaggttcaatcttcacaagaaaattattcacagaaaaattatttaaaactttaaggaaatggttaattctgataacatttacattttttgtaaaacgaaagaatacacagtttttaaactaaagttaaaatattaccccatgacacagatataataaaaataaatatgtgcaaattacaaatccttttcacttatgcatgtaacacttaatcacatttaacagatcaaagaagaaaaataatatgatgattttagatgcttaaaagacactgaacaaaattgcacattcaggataacagacaaataaccactaccagcagaatttctgtgagaaaaggatgccaaatatcttcactgcaggttcatattttttctggactagtttaaacattgctattgcaaaacaacaaccaaaaaaaaaaaaaaaaaagaaaaaagaagaagaagaagaagaaaccacagaaatgtatggaatgggcaaagcacatagagaaaatgtggaaatgtgttaaagaagttaggataacagaaggataaatatgatttaacggtaaagacattctggaacactcacagtccagaggtaaaaggagaaactactaagaaaccatgattcgttggagtcaccatgaaaattagcatatatggaagcaaaatagaagctgaaaaccgacccaaaatcagtgaaatagttaagaatgaaagggtggagaaagaaggaaaggggaaagatattatatcacatagtaattggctaaaaaaaaaaaaaagcaaaaaaaacccacaaaatctcagcgacatctcaaagttgctaccccctccccacacacacacacaggatctgaaaagcaggaagatagagctgctgtctagatggaaaatagcagctccaactagacgatctctgaattgattccattaaaagacaattctttaactgtgtgtgatatttttgttttacaggtgccttcatagcagtgaggaaagatctagggacatatctgctcacatccatgagaagagtgatcattgaatttgtcatcgaaaccaggacatttttgagactgaaagagatgagtattaacaactcatctccatcatattccaggacagcaggtgtaaaccagaaatgtctcaggtaaacgggtatctatctgtgatgatttaaaaatttttccattttgagaacatcagcattattatgtattttagatattttgcaaaagtcattagcattagaattaatatcataatatcataattcagatagggtggtaggtaatttaaatatgaaatgtttatgaaaatcaggctcttgaatcgtgtgtttatgatatataattttgtaatgtaagattactatgaactccaattttaaatttaattcattctacttttatatactcatttctactttagttcacattttagacaatgttagaaaataatggaattaaacaaaaatcaaagttagaagaggcatcaagaagtggaatcctccagccctacattttgagcatgagtcctatctgcagggtgttccatcagtggctgtctggtctctgctcctttagaggaccatactctgtccttccccatggagtgaggagtccaggcagaaagggtgtgggccctcctggaactggggagccagctcgttggccattgtgtgcaccctcggacaggcagtggccaaagggcagctacttatgggcatttgggtggagtttggataagtgggctggggtctccctgtggctgtgagaggtcccccatacctgggggagggaagaaaaggacctgagtggggacagggaagggggaacctctctgagccacagagttccagaatggaacccaaaagagtataatagtctaaatgtgaatctggaaatgtaccatgtccggaattggtgggttcttggtctgacttcaagaatgaagccacggaccctcacggtgagtgttacagtctttaaaggccgcatgtcaggagtttgttccttctgatgttcggatgtattcagagtttcttccttctggtgggttagtggtctcgctggcttcaggagtgaagctgcagacctttgcgatgaatgttacagctcataaagggagcgtggacccaaagagtgagcaggagcaaaatttattgcaaagagcaaaagaacaaagcttccacactttggaaggggaccccagcgggttgccactgctggctggggaagcctgcttttattcccttatctggccccacccacatcctgctgattggtccattttacagagagctgattggtccgttttaacagggtgctgattggtgtgtttacaatccctgagctaggcacaaaagttctccaagtccccactagattagctagacacggagcactgattggcgcatttacaaactttgagctagatacagagtgctgattggtgtatttacaatcccttagctagacacaaaggttctccaagtccccactagactcaggagcccagctggcttcacccagtggatctggcacaggggctgcctgccagtcccgcgccctgcgcccgtactcctcagcccttgggcggtcgatgggaccaggtgctgtggagcaggggacggtggggcaggctctggcctcacaggagcccacagtggggttggggggttgagggggtgggagggggcatggcggcaggggtggtgctcaagcatggctggctgcagtccggagccctgccccgccgggaggcagctaaggcccagcgagaaacccagtgcagtgccggtgggccagcactgttgggggaccctgtgtaccctctgcagctgctggcccgggtgctaagcccctcactgcccgggcgggcaggggtggccggccactccgagtgcgggcccgccaagcccacgtgcacctggaactctagctggcctgcaagcgccatgcacagccctggttcctgccagtgcctctccctccacacctctccgcaagcggagggagccggctctggcctgggcaggcccagagaagggctcccagggtgcagcagcgggctgaagggcttctcaagcgcggccagaatgggcgccgaggtggaggaggcacccaggcagaggaggcaccgagagtgagcgagggctgtgagggctgccagcacactgtcacctctcagtattatgaaggtttatttttcaaggcaggaggatagcacatatcttatttgtttttaatcttgatttgtatcttttaaatatttaaatacaaaatatggcatttgggccagcatttgtactcttgcccagagtgtgcaaatgtgaggagcctgtcttgagtgatggggagctggagttaacctgagaaattccattattggacatggctagtggttaagaagcttttttaaaaaagtaagccaaaacccattttttatatctactctttgtatccccaaactatatttatataaaactctttaataattcaattttctccttagaacatcttccttagcttttctcaacttcatgttgatttacagtcaaaacctgttcctctgattcctgtaagaaatcagaaggaaaagaatgcaaaatctatgagcagtaacatgcaaataaaatcttacagttacaacacattacaattaaaaagcaaattccattacaaaattttatttgctcgtttcatcagatgtgaaaggcaggtatattgttattatttctattttatagataagaaaagaggggtttaaataaaggtgatttccataaggtccccaaactggcagatcttcagtctggttgtactttaacagctgtttgagcacagaaaagtcattatttcttaattccagtttcttcatttgtagaaagctatgatctgtttgccgaagctgcctctaagcttcacttggcccgtgtggatgaaatggggtcaatatctgtatccgccattgattgctgcatgacaaaacaccccacagcttagtgcttcagacaaagacacatgctttctcatgagtctgagggctcactggtctttcttccagtgttctcgactggtccctcacgtggctgcagttggctgcagttggctgcagtctcagctgggacctggctgggcggccgggcctggcttccacatggtcctccattccaggctttctcctgtgtttctggaagtgttccaagatgccaaggtggagtgagcaaggccattgaggcacctggcctcaggcactgcacccagtccctcccatcagatactattgctgaaggcaacaggtaaggctagcacaagttcagaggatgtggacaatatcctcctcctcttaaagaaagcagccaccaagtctccttgcaaagaggtatggaggtgagattcactgggggccatcaaggcaacaatctaccacctgctacattctgaccccaataactcgcatgcctgcccaagattcccaaagtctcatcttaccccagcaccgggtccctgcacatttcaacaagcctgagatctgacgtaacattctcccatttagttgtctgggtacagcaataaaacccaagatccctaagtctaccaaggaaggctgctaactttgggaagggttctaaaaagaattgtacagtgacgcccagtgtgttaatatagttaatgctcaccttaaatatgcagtcatgcagccagttgaaggcagcgcagtgattcaccttctcccagtgcggcaggacttccctgatgagtgatcaatgctctccattaaaggcttcctgtttccttctgaccctgaaaacttagtatgcaagagctacgcattctgtgcacagacaaagaacaacactccacggtgaattgcttttataacctttggctttattttccagtgaatcgtatcctgtaaacaggaacctcatgagaaaacataaatgagcaataatcttttcctatattggtaatcagataaaagtcctgattcactttccaattgttttaacatgcataaaactctcagtgcatctatatcagaaaggcaattcctggattcatttatatatgtgtgtacacacatacacatacataatgatacacacacataatgatatgtatacatatatacatgatatacatacacacatatacataatgatatacacacgtatatacataatgatatatatgtacacatacataatgatacacacacataatgatgtgtatacatatatacatgatatacatacacacatatacataatgatatacacacatatatacataatgatatacatgtacacatacacatatagttacttaatgatgcacacatgcacattatatgttcatgtatcatatgtacataatgacatgcatacctctagtacatacgcatatgtacataatgatatacatatgcgtacatggttatacacatacatatgcataatgagatatacacacatacatacataatgatacacatgcacacacatatacacacataatgatacacacacatgtatatacagacatccatcatacacatatacacaggttttggggctccaatacttttcaattttagctagtcaccagttttacagaaacacacacatgcatatttggatggctcacttttagggcttcagacaaactacacttcaagctgtcagctatgtctttctgagagggccagtgtttcctaagtggatgcttggagattgcaaccattaaaaaaatggcagtaaaataaatggcagtaaaaataaaaaggagacaccctgtggtgaaataatttggaagtgaattctataagcatggtgcagatggtaggacagctttatttcaaaggagatgatcaacctccatggagtctgttaccattgctcaggcaagggtgtttaattgcttcatcactgacacaaaatcctttgcagattagggactctcacttagtgtaatgggctctcacctggggcgacagggcttctccctggtggtcaatcgctcgcctggggtgacagggctgtcacctggtggtctcacctggtgtgacaaggctgcccctggtggttaaggtctcacttggcggtcagtttttttttccagtgttccagttaatgttgatcaatgtgaaaaaattattcttattaaaactaaagctacctattggttaacacatattaaactgtagggcctgtaacgtgtagtatagggtgaaccctattgttggttccatggaggaagcaaacatctttgaggtatttttcaaataaataatttttaaaacactgtaggcatttggttccaatctatgcaatcagaaggatcgtccctctaaggaatgggtggttacctggaaaaacataaagggatttctaactgtaaaagctacctttacatcttgacagctgagtttgcaggcctgagagtagagtttattttaagcctaagaaagaaagatctcaggatatgatgtaagggaactcttcgtgctacaagcagcagcatagagacactctggattagagaggtgagaggaaggcaaggaagttggcaagtggagcgcatggggtggggaggagagagaactagggtggaagcagccagatgacttcatgactgtgtgggggctctgtgcagggtcgtggaatatgggtaaatcccattggtgggtttgaggttgtggctgtcaccctcgggctgcagcgtgtggctctgggaaaattcaaaaagcccctggggccttgatgctctgtggctgcggaggagggtactcagtgtggagcaggtgaccatggccaagagcagggaggaaagcagctctgaaagaggactcctttctgggtatcttttgcagattcattgctgtttagcaaatatgaatgcaaattcaaaagattaatgagttgtgagaagactgctctagggaattctggaaaatattgctgtctaagcaccagttcctgctccattttccacatgcccactttttatgaagcaatgcaacagcagggcgggcgtgctggtgcagacagaagggagcccagagccccaaatcctctcactgtctacaggaaggagggaagggctttcttttctctgatgtcaggagagagctggagagttggaggtggcggagggcatgggcctctctcaaggcctgcaaataaaatcattctccatcctcacttggggtggccccacagcacaagagggtggcccacctgctgtgagtgtccctgcagaagccttcctgtccctgtctaatgttcctctagtggccttcctttcattcctgtggccctgtcatagctacagcgtgaacctggttggaggagcccgctcctcaacagagaggaactgcaggcttcccccgaacccgttctgctcagcagaaactgctgccgtccaccacttcctggtttgtcacagctggaggaaacctaactgtcctaaaggccacaggtaaataagaaaaaaaaaaaggaagttaaggaagcatccagggggatttcttgggagggctggaggagaagatatgcagtgacggcaatcctccctcggctatgtgcatagaacaataactttgttccccataactctcaccccacacctttgcttcactcgtagaaaatcctccccaaagtggtgtctctacttgttgccatgatttctcatctcctcttttctgcctaacctcctgccattgagtttgtgtccctactgctgctttgcaaaggctcccatcacatcctccaccatggtcatcttttcaaggccagtggcctgagaagcagggaagctgatagtataagtcccagcctgagaatgaaggctccagaactgggagagctgatgtccaacagcagaaggtggatgtcctggcttaaccagaaggacagaatctgtctttttgctctcttcaggaacccaattgattggaggatgcccaccagtactgggaaaggcggttaggtttactgagtccactgattgaaatgctgatcctttccagagacgccttcacagtcatacccagaaataatggtttacctgtgatgtgggaatccttagcccagtcaagctgatacctaaaattacccatcacactctcaaatgtgcactcacaggcagatgtctcagtgatgcgtcatccagaaggagcagttgtgtgctgtggagccataaaaacggtacttatgagaaggcttttaatcatgtgaatattgctttagtaattgcacaattggaagacccagaactgtatatataataggagttaaatacaaagaagtccaccaaatattagctcggcttatttctgggtcggagagcgatgcctttcatatacatagtaccaactttgactttatatataaaacaggtagataaataaaggcgtaagttttgtggaaacttccacgtaaactggtttctggtcctgcttttgagtctaacaaggtgcatgttaatctgcgacaggagaatcatgtttctacacttcatgcttgccctgccttgaacttttcattcttctgctcacctgagacaaatgtgtatctgattgcttcctctgatgtagaaatgcagatttactgggccagacaaaggcataggtgactattactctacccacctctcacacgtaaattatgtattccgcgaaaggctgatcaaagactcaaaagaattcaaccatttgtctcttatgtacccccagctttaaaaaatttcttcctttccccccagtatccaccctttcccctttaaaatactgaagtcctcaaaaacatctttggagaaagacacagatctatcttctgggcatgcatccttaaccttggcaaaataaactttcttaatggattgagacctgtctcaggtactttttggtttacagcatctattaacataatcacatgatttttctgtcttaatttgattctgtaatgaagtatgccaacagtttactattatctaaccatctttgtacaattgattattcttgcggttatttttgtttttaaagactgctagattctatttttgaactttattcataattgagattgacatgttttctttttaaatttattataacagcataataatggcttcttaagtaaattgaggtactttacaatgtcttttcttttatggtcttgaatattttaaatatcactggaatagtcagttgtttaaacattagatagaattcagttgtgaaacaatatgtgtatagtgtctttttatgaaatggcatgctttgccccatttccaatcttttatgaaaattatattttcttcttccaatgtacattttgataggacattgtatgttgtgttgccatggagttgtatgtggcattctcttacaattcttcaatcaactgtatttatgacagtgtctctcttttcatgtcttaacttgtgtcatatttatcccttcctcttttcattcattgtctcaggggaggtttatctattttgttggtcttttcaaaaacaaagttttggtcaggcctggtagctcacgcctgtaatcccagcactttgggaggctgaggcgggtggatcacctgaggtcaggagttggagaccagcttggccaacgtggcaaaaccccatctctactaaaaatacaaaaattagccaggcgtggtggtgggcacctgttatcccagctacttgggaggctggggcagcagaatcacttgaacctgtgaggcaggggttgcagtgagctgagatcgcaccacttcactccagcctgggagaaagagcgaaactctgtctcgaaaacaaaaacaaacaaacacacaacaaagttttgaatttatttgtagctttttaatttcaaatttatcaatttcagctttcatctttgaaatccttctttttttatctttattgctcatttctatactctttagctaagtacagaattcttttatttttagtctttttttttaagtaatgaaggcatataagactacacatttttcccttgagcacggtagtctcaggatttgttgtgatttttttctccctttattgctttctgacagtttgtggaacctaagccctgctttgaagtcctctatgcgtcacgtggagaagtcagcaaggtctggtctcaggagtcagcagcagccctagagccagatgtgtgcactgtggcccctgcctttgaaagactctcatccacttgccttaaattatagctttctgagctcagacagttttatatacaattctcattctgtcaagcttatgcaagtcatttgggaagagtatttggcaggaagcaatgttcagaaaggcagcccacagagattgccttgaggggcagcaaagacaaagaacttttagaaaaactatgaaagatatcccttaagttttctgtattttacatttgcacaccttggcaattgccacctattttactcataagggactgtcaatcagatatagatttcttttctttttttatttttcccaaaatagaccagtttgtaaacatggcatttttttctctttttgaggttaattctgtatgtttttccctgaaattactgagcttcaacaattctgtacttttaaaactccatagtctttacttcaagggagacatactgcttattctaacattctatattattttaaaaatattgatggtaattaataccatgtaagatttaatgccacatagtccacgacttacaaaagtagctgtatttcaaaatcctgagcatcaagaatacatcaagagaagcccacacagaattgatgctctgccctcatttattgcagttttactctcatctagctgtgaaaaattcagacttgacttgacatggcaaacaatagggaaagaaatctttagtttgccaatcatttttgccgaaataactaagttcaggctgccattaaaaagtaataacagaagaaaggaatgatgaatgactattactatgaagttgtgctctttcaaaagcatggtctcaacaagtttctcaatcttgcatgcaggagaagcttctaaagaacaaagaagcaatacagtatgccagaagacatttatttaaatgtcacttatgcattgggtaatgagaaatgaaggtgctccatttgagataataaaccaatttttgcaagagaagatgaagtaattaattattcaagggcaataacttctccttggacttcattttctcagaccacatttacccttagctgttggaataaaaaacagacggtacactacagtcacttgtacctacttaaagaagacaccaattgtaattcaattcaggaactcttattttgcgtgtctgttattctcaaaggatgtggccaggcatggggatgacatctgggtgaggtgggatccctgcccacccactgtgataatggtagtgtttgaacaggctgtggttccagcaaggtcagagtgacaaacagaggaggcattcttcagatccccagcaaaaggaagcttcctctgcctttctctgggatacctgggctctgccattctgatggcagctctagcccacagtggcttcatgtctgaaggggctgtggcatcggatggattctgcagcaggaggctgacaagccacaggcccatcaaagggatcccaggcttactttgtttttttaaaaacttctgttgcaacagttttgggagaacaggtggtgtttggttacaagggtaagttcttcagtggtgatttctgagatgttggtgcacccatcacccaagcagtgtatactgtacccaatgtgtagtcttttatccctcaccccctcccaaccttcccccgagtccccgaagtccactgtatcattcttttttttttttttttttagacggagtttctctcttgttgcccaggctggagtgcaatggtgctatcttggctcatcgcaatctccacctgccgggttcaagtgattcccctgcctcagcctcccaagtagctggaattacaggcatgcaccaccatgccctgctaattttttgtattttcagtagagacgtggtttctccatggtggtcaggctggtcttgaactcccaacctcaggtgatccacccacctcggcctcccaaagtgctaggattatgggtgtgagccaccgtgtccagcccactgtatcattcttatgccaagcttgctttctaatagtctcccgaggaaactgttgctggaaggaaggattcttagaattgagaattgagtttggtcattattcatctttgctcttaacaatatcctcttaggcttgctggttgctgagggaaagatgtcttaaggatttggagaagttatttcatatagagaggatgctcctgggctctaaaaagcaaatgatgtcaagcatgctctgctttgccagttgaacctgccattgactttctctagggcttaacattctgagggagttctacaagatgagttctgtgttctcttttagttccaaatacaggactttttggatgatgtaaagatgtaaagcacaagacttccttttagttaaacatgaaagagtagactgcatttacctatccatttttctacagaaaacctactgtatttgtcaaggttctatttatttatgtattatgagaaattagctcaaatgattatgaaggctgacaagtcccaatatccacagggtggattggcaagctggaggcccacgagagcccatggtgcagttccagcctgaaggctggcaggttggagagtcaggaagaactaatgtttcagtttcagtgtgaaggtaggaaaaagctgatgtcctagttcaaaagaagcaaggcagaatgaatggcctcttattcagggaaggccaggctggtcctctattctaggccttcagctgatgggatgagacccattcacactggggagggccatctgctttcctcagtccactgattcaaatgtcagtctcatccaaagcaccctcacagacacacccagaataatgtgtgaccaaatgtctgggcatcctgtggcttagtcaagttgacacataaaatttaccatgacacctaccagaagaatagtttaaaaggacaaaaggagagtggggagaatcagagagctgcaaaagtgttgggtacaggatggggagactggcaagattctagtgactttctcgatgacctgaggctgatgaaatagtcatggtggtggtaactacagatcagcgcttcatagacaagactggagtagtgagagaagtttctctctgtggtgacccccagggtcaaggggtgtgcagaggagaagcctaaaccaagatagttaattgaaaaaggttctctgcagacagttgcaagagtcagctttctccacattgagacggaacagccaactccaggaaataatcactaagaaaatggaatgatctcctggtaggaaactggagtcaaagagtggggccctgtgcctccagggagcctcctgctggatttggcatcttgtggggagcccagtctactcctgtgggctttgcccatgtctcctacagggaagcctggcagggtacttgcccaccttcatccacagggccatggccagctcctcacccctagaggaagcacccatattgattagccaatgtttccattcatggaaacgacgtcttcagaaaaaaaaaaatgcctattgttctctcaggaatactagacacatacactccggtatttattccccaataaggtgaaacccaatcacacaggtaagatgtaaacctatcaacctctatccaaggtggcatgtgagttctgggcacttctgttaactcaagggataagatctgtaaccgcatgtaagatttttggagttcaggcatttgtaggaaaggaagagaaatacttgctgacttcccatgacattttaatgagcttttgatgattttcccatttattttgagatgagatcagacaatccttttggttttacttatataagttcaacctcctttgcatcctctcctttcccacagaggtaatttctattcctgatcctgagaccttttgctttctttttgcctttttcatccattcatgtcattctcattccttacagtactttttccaggatggtgtttctgaccatgctggcccacagtcaccattcttcccatactctgagccatccttgccatccctggcaccatgcttttcatccaactgacccactgggcaatcctagcatcagtggcaagggagatgcctcagatgatttggtgttcctcccagcactctgtggcattgtgatctctccccctcagcccttagactgtcttttattccagagcatggaaaatgcttcatagcagcaagactgggctgctgtgaggctctgctctcctggagcctggacttctgtgagcagtgtggagatgctgtgcctatgctcatctgctctcatgctgcacctgcactgccctgaatgtggtgtttgtaattctcccacttttcttcatatttcaactatgtcagttctcctaaatgataggacccttccaatattttaaaacattatataaatattatcataccgtgtatgattttgcaactttcttcacttaccatttcatttgtgagattcatctgcaatgatctatagttgattcattttttgcttctggatagtattcctctcttcctaatatttcaattggcgtattattacttttagctatttccagcaatgcctatgtgaac

SEQ ID NO: 126 - DNA, 17 bp, artificial sequence
  SYK forward primer
gggcgcgatattgggag

SEQ ID NO: 127 - DNA, 25 bp, artificial sequence
  SYK reverse primer
gcgactcttcctcattttaaacaac

SEQ ID NO: 128 - DNA, 22 bp, artificial sequence
  SYK probe oligo (6FAM--BHQ-1 format)
ccttaacgcgcccgaacaaacg

SEQ ID NO: 129 - DNA, 2132 bp, Homo sapiens
cgacgggacgtagacaaaggacgtcccgcgcaggatccagttggcagcacaccctagcagccatggaaaggaggtgtatttccgagagaggacaacagagttgtcggtgccgataagtttcgctccagaccggctgcgagcaaaacaagctgctaggagttccgcagtatggatcggcagaggagccacaaaggttccacgcatgcgccgatggcctatggccaagccccatgcagtgggggttgcgtcagcaaacacttggcaaagacgtgaccgttgccgggcaacggggtaaaggttcagatattgtttacacagaaaggccttgtaagttggcgagaaagtgaaagcctgcttagattgtatacatgcatataaaggcattaaggcaggatagccacattgtgtaaaaggggcaacaaagcccaaaagacccacaattctttggcatactttccaatcaataggtctatttactttttcacctctgcctaatcatctcatgttcatgtcctactgttcaagcctccaagctgtgccttgggtggctttggggcatggacattgacccatataaagaatttggagcttctgtggagttactctcttttttgccttctgacttctttccttctattcgagatctcctcgacaccgcctcagctctatatcgggaggccttagagtctccggaacattgttcacctcaccatacagcactcaggcaagctattctgtgttggggtgagttgatgaatctggccacttgggtgggaagtaatttggaagacccagcatcccgggaattagtagtcagctatgtcaatgttaatatgggcctgaaaatcagacaactattgtggtttcacatttcctgtcttacttttggaagagaaactgttcttgagtatttggtgtcttttggagtgtggattcgcactcctcccgcttacagaccaccaaatgcccctatcctatcaacacttccggaaactactgttgttagacgacgaggcaggtcccctagaagaagaactccctcgcctcgcagacgaaggtctcaatcgccgcgtcgcagaagatctcaatctcgggaatctcaatgttagtatcccttggactcataaggtgggaaactttactgggctttattcttctactgtacctgtctttaatcctgagtggcaaactccctcctttcctcacattcatttacaggaggacattattaatagatgtcaacaatatgtgggccctcttacagttaatgaaaaaaggagattaaaattaattatgcctgctaggttctatcctaaccttaccaaatatttgcccttggataaaggcattaaaccgtattatcctgaaaatgcagttaatcattacttcaaaactaggcattatttacatactctgtggaaggctggcattctatataagagagaaactacacgcagcgcctcattttttgggtcaccatattcttgggaacaagagctacagcatgggaggttggtcttccaaacctcgacaaggcatggggacgaatctttctgttcccaatcctctgggattctttcccgatcaccagttggaccctgcgttcggagccaactcaaacaatccagattgggacttcaaccccaacaaggatcactggccagaggcaaatcaggtaggagcgggagcattcggatcagggttcaccccaccacacggcggtcttttggggtggagccctcaggctcagggcatattgacaacagtgccagcagcacctcctcctgcctccaccaatcggcagtcagggagacagcctactcccatctctccacagctgcgctgtcggggccaggccgggctcccagtggattcgcgggcacagacgcccaggaccgcgcttcccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcaggcagcgctgcgtcctgctgcgcacgtgggaagccctggcc

SEQ ID NO: 130 - DNA, 21 bp, artificial sequence
  TERT forward primer
ggattcgcgggtatagacgtt

SEQ ID NO: 131 - DNA, 16 bp, artificial sequence
  TERT reverse primer
cgaaatccgcgcgaaa

SEQ ID NO: 132 - DNA, 23 bp, artificial sequence
  TERT probe oligo (6FAM--BHQ-1 format)
cccaatccctccgccacgtaaaa

SEQ ID NO: 133 - DNA, 3825 bp, Homo sapiens
ttcctgttaaggggcgcagacactccctcttctatgacctttcctttccacccagaacaactgaagtatcatgataagaggaagggctttgtgtttgagataagcagctcctatacctgtcagctttctctaataagaaagctctttcctgccaccgtataggtcaccttcttattggtaaaggcatgatgaagtttggaaactgttgtccttgttttgttgaaagaagccaagttccaagaaatctgcagaggcattcctacaatccctcagccatggcagcatgaatcctgaaggggcagtgagtgctggtttctactctgtctgcacagctaagcctaggggagataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatacacacacacacacacacacacacacaccatcttgtcatacaacactcccacgcaagaaaagcgaaactgctgtttgatgaatgtaaacacttggctgtttgcagcagtcgggagtcctgccgagtttaagtgctaagatgggaggtgaaccccaggggtttccccctgcccgtgctgagatccttatttggtcaagcttctacctatgcctcggcctcggagcgagcccgatagcgctggatcacagcagagggagcgaggcggctgacgtcccatcccgaagagatgaatggaattccaggaagctagagtcatgctggcttgggacagtggcttggagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaagaagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgtctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctcgccatcaaccaggcattccgggagatcagctcgcccgaaagcccctgcgccaccccgcgggccctcctaggtggtctccccagccccgtcccttttcgggatgcttgctgatcaccccgagcccgcgtggcgcaagagtacgagcgccgagcccgtgcgcgccaaggctgcgtgggcgggcaccgacttctctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactcagggaagagtctgtacttcccctgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccaggtgagtttgtgtggcacctttaggggaaggagggacaaggaagaggtgctggctatcctaggtgtgccccctcacgtgctgtcctctccctcttgagcctgactggacatcaggacgcagcttcactctgatcttggtatttattcacctctttcagtggttcgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcggacagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagct

SEQ ID NO: 134 - DNA, 18 bp, artificial sequence
  THBS1 forward primer
cgacgcaccaacctaccg

SEQ ID NO: 135 - DNA, 25 bp, artificial sequence
  THBS1 reverse primer
gttttgagttggttttacgttcgtt

SEQ ID NO: 136 - DNA, 19 bp, artificial sequence
  THBS1 probe oligo (6FAM--TAMRA format)
acgccgcgctcacctccct

SEQ ID NO: 137 - DNA, 1186 bp, Homo sapiens
gatcgcgccactgcactccagcctgggtgagagagcgagactctgtctcaaaaaaaaaaaaaaaagaccgccagggctcaaacaaaaaacctcggaaaagccctggcggtcttttttttttttttttttttttttttttgggacagtcttgctctgtcgcccaggctggagtacaatggtcggatcttggctcactgcaacctctgcctcccaggttcaagcaattcttctgcctcagcctcccaagtagccaccacgcccagctaatttttgtacttttagtagagacgggggtttcaccatgttgtccaggctggtcttgaactcctgacctcaggtgatccacccgcctcggccccccaaagtactaggattacaggcgtgagccaccgcgtccagcgccctggcggtttttaatcaagtagaaaagctgcattataccacttgcttcggttgcttcagtgagaacgaagaaatggaaatgcaaatcccttattagttgtaggaaacagatctcaaacagcagttttgttgacaagaccgcaggaaaacgtgggaactgtgctgctggcttagagaaggcgcggtcgaccagacggttcccaaagggcgcagtccttcccagccaccgcacctgcatccaggttcccgggtttcctaagactctcagctgtggccctgggctccgttctgtgccacacccgtggctcctgcgtttccccctggcgcacgctctctagagcgggggccgccgcgaccccgccgagcaggaagaggcggagcgcgggacggccgcgggaaaaggcgcgcggaaggggtcctgccaccgcgccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagaggtgacgccgcgggcccctgcgggacgggtggcgggaaggagggaggcgcggctgggga

SEQ ID NO: 138 - DNA, 19 bp, artificial sequence
  TYMS forward primer
cggcgttaggaaggacgat

SEQ ID NO: 139 - DNA, 24 bp, artificial sequence
  TYMS reverse primer
tctcaaactataacgcgcctacat

SEQ ID NO: 140 - DNA, 29 bp, artificial sequence
  TYMS probe oligo (6FAM--TAMRA format)
ccgaataccgacaaaataccgatacccgt

SEQ ID NO: 141 - DNA, 25 bp, artificial sequence
  ACTB forward primer
tggtgatggaggaggtttagtaagt

SEQ ID NO: 142 - DNA, 27 bp, artificial sequence
  ACTB reverse primer
aaccaataaaacctactcctcccttaa

SEQ ID NO: 143 - DNA, 30 bp, artificial sequence
  ACTB probe oligo (6FAM--TAMRA format)
accaccacccaacacacaataacaaacaca

SEQ ID NO: 144 - DNA, 30 bp, artificial sequence; identical to SEQ ID NO: 143
  ACTB probe oligo 2 (6-FAM--BHQ-1 format)

SEQ ID NO: 145 - DNA, 31001 bp, Homo sapiens
atgattcgcctcggggctccccagtcgctggtgctgctgacgctgctcgtcgccgctgtccttcggtgtcagggccaggatgtccgtaagtcttcccccgccgctgcctgcctgcctgctttccatgcgtccctcagcatccttctccccggcccgctccagctctggagcccgcggctccgggctaaaacggctcccggggtcgtagcgcgccgacttaggcacaggacacgcagaagttcaccaagaagagttctgccaatcaagactctgtcccagggtcctcggtgcccatcgcagttgcaagtatttgcaggtccctacgttgcgctagaatactgaacttgcaaagtgttggctcggagaagtttgcgcacagatataaatgggctcttttccaccagctttgataattaggcgcacatgcacacagctcgcctcttcgaagcacttcgagttcagcaaaaacagatctcaactcatcgaacttaggtgaagtaggaaagagagagcgcgacggggagcaagcaaacgccaaagggttgacttcacagcctgtccaaggcttggtggctggtgggctcaaagcagagttagacaaaggggactaacactctgacactggtgggctgaaatcccaggccacaaagaacggcttccgataggccctctgagacctcagcgcctctttagggtaccctccccctcccagctggccctggagcaaggtgcagccctagcgctcatctcgacttccctccgtccgcctgcgcctctcttctgataaagggtacagaaacttccagtaggagaggccatctgaaagacgataacattccaaccagaccgtgcttttcaaatgcccccgaaaatagcgcccccttccccgcggtcttaccccattccccgccgccccgaggtactacaatgagttacttttctaaattctggaactcaccgagccaggctgcgtggtgtgtgtgtgtgtgcgtgtgtgtgtgtgtatgtgtgtgtcagggaaggggagcaggctggtcgattgctacggttgctacaactatttcaaccggtatagttagagatggctcttgtagtcgggtccaaatgctgttcggactgcacctttctacccctcctttggtaaggtccactgtctgggattatattcaggacaaacgaagcctggaaagtgtattaggtagagaggatttttttttccacgtgtttgggcacgtttccgacggctgggattccagccctgtctttgtatgttacagattgtaaatcaatcgcagagggaaactcttcggcgggggaaataaaagttctctgccttcgaggctctgtgggccctctcctgccaccaggctgtttccagggatagcgtggaaggcggcgggctcaggcgggctttccggtcattagcgcagcgggggcagggctggagcctgcggcgcagctgcgaggagccgggagcaggagactctggccgggtcacccggtagtgcgctaagctggaggcgcgctcctgggcatttgaggaatacagcgtgactatacgtggcctggactcagactgactatatttttgtactaaatttacaagcacacgcccacaaagctgtcttcttgactgacccctgccttagtgagcaatggaattagctgggtggctttaaaataattctcaaattctccatccggtattagggtcgcttgcttaattaggcggtagaggtctctcatcgccgcatctttcctgggagggagtgattccacagcttctccggcccaaaccttccagtcgctcctcctcccagagggagtgtgattctgcatccgagaggctgattttgcgccctggagcatcccaccttttataacttcccccgcctggggtcagcggacccaaaggtgtgacgtggggaaatgcgcagtctgcgtggacgtcaggaatgtcagacacctagagctcggccacacccctcctctccatctttccacgagtttgagaaacttactggcggcggcgtctttgaccctcatctgcatttcagagccctcgcctccgaaagtgcccctggctcaggggagagatctcaatcctcctttgtgaggcttgtttgcattgggagattggcagcgatggcttccagatggggctgaaacgctgcccgtatttatttaaactggttcctcgcagagacctgtgaatcgggctctgtgtgcgctcgagaaaagccccattcatgagagacgaggtccagtgggttctctcgtactcccagaccccctctcccacaatgcccccctgtgcccgcccgccgccacctctcggctccagccctgcgcagagcggcggtgaagcaaaacagttccccgaaagaggtagctttttaattggcttgccacaaagaatcacttatacggccctgcggtaatgaggggaaccggatcaggcgcgccgggatgctatcggcagccgttttggagcagcaattatggtggtgctgggctcctccgtccacacctaggggatccggttacggcgctggctcctttctggggcagtcatttaatcccacttttcactctcccggtgtctgtgagcgagccgtgtccagagccgcagccacagagtcactcagcggctcttacacccagcgcagcctggccccgcccctgcgccggcgcttcccgggccgcccttccccgggaaatctgatccgcacggggagtggcccctctcctagcatttccccctctcctccctgggtcctcatgggcgagggtgggctctcctgtagtctgggctggagcgcattaaccgatgccccctctcccacaccttcctcaccgcctgcattccactgctccagctattttaacggcgggtgtgtccccgcaacttctgtattttccctggaatccctcaccctcctgtgattatcttgcccaaaggctaggcggatttcttctagtgggaaagtaaaaaggaacgtttatctttggattttcactctctttaaagagcagtgggcaggctcgtttctttctccgcctctgggtttgtggctctttcctattattcatcccctgctgctgctattgccttggggattttgatgagaaaaacacgctgggcgctccctacgacgtggtgcggctctacagcccttggctgctaaggagcgctcttgtcagcacaggtttcatttgcagcatgaattccagacggcagggcgctggtggaggagactagtccctgctattcttcctctgcagtcttggaggaggccaggcctggactggcaatcttagccctagccaggtattcaacgacccctgctccccaaactggggtgctgttttcagatggaggcagggcctctccaggcagggctacaggtggaggtcagcactgggggcgctttggctccactggcctcctaagcagtttattagcctgcccaagccccaagtgtattgtttgaatgggtctatccccctccccaaattggtcctaattctaatatggttcaaagaatgagacaagatcctaattctaatagctcgtcttttcacccccctttcttatatacctatttttggagcctcactgcttatagattccaatttttgtaggtagaattttctacattccctctgaatgttagttgtcagttgtatttagctaatcccataattcccagaggaaggcagaagaaagaagacttctctgctcctgggctggtggaagggaggtctcgccatttttctgtctcctttctttttatagtcccagaattcctattcagaatatcttgtctcctcccttccgctcaccctccaactccctccacccactccatcacctggtctcccccgtattaggtgggtaaagagaatatagtatagtaaccccccaccttcattgctgggtcaagattttcactggtgaatagacaacatggtgcaaggtgcataataaatatttgttgaatacatggaaaaatcaatgatgttttaggaaaataatttttaagttctatatgtccaggtggccccagcctacattcttcagcatttgaattctgtcaagttgactgcaacctctctctttttctctctggctccccaccccctccttcccttggctctctgcttctccctccccacccttggtgcagaggaggctggcagctgtgtgcaggatgggcagaggtataatgataaggatgtgtggaagccggagccctgccggatctgtgtctgtgacactgggactgtcctctgcgacgacataatctgtgaagacgtgaaagactgcctcagccctgagatccccttcggagagtgctgccccatctgcccaactgacctcgccactgccagtggttgtaatttatttatttcctgttcaacataaataaattacttgcaagcactgcaaacacgctcccatagatgctggtcgtctctgcaaagcagaggggctagttatccatgggacctggtagctggggtagaaaaggaaaaggccacttctcacttgcaggttgaaactgagtgaatgagcctgagacactagaggggtccttctttgcccaacatctccaaaaacatttgcttccaagacacatgaaggacagatgtaattctacaaaaaaaaaaaaaaaaaatcctctctgaaatcatctctgcaaattactagagccactatggagatcaaatgctctgtcttggccaatccacgaattaattcctcctctgccaccgataccttgtcttctccttagaagacttctatgtatgtggtcttcagtgtggagaaagctctgccagctagtggggagactgcaggggcagaggctccctctttgagttatggaacattggtggtagtttcctctctgctattacctctcttggagttgaccattaattcagaagcaaaataataagagagggaagggctaggctttgggagttctagtggggacgggtggagacagagccccatgtatctgcactgtagtgggtggttataaactcccagttagatccagtgctggtggatgatatatgtgcaggtgaccccttccccagcattcaatacaagatgtcctatctcccctgcagagtgagtggggacgcttgtgtaggttttttgggtagctcttgctgtccccttcctgctgaagtagagaaggccgtggcaagggaagtgagaagctgcctttccttaacacttcaccaacactggctccctaatgtgcacattcccagatcctttctgaggggcccgtgtgagtgaagtgttgattgcctttactattttgctgctactgtgaaggagaggttattgactggggtggcacaggctatgatgctccgatgctcttcataactcatatgccttgctgtttttgtgtttttatttgtgcttgcttcaaggagacccagctctaatgtaagacctttctaagtacctaactcttcctctgggagggcttggggttcgggaacggctccctacctgtggggggaagagagactgaatctgtgctttccttcttgtggctgattagatcttgagctcttcattgcctttttgtgctgcccttgctcctttcttttgcatgctgcctgctttttgaataacaaagcctgggtcacctccatatcctcatgggacctcagcaaccccaggccacagtggccctaacaccccaacagaggggttcagtggagtcacaggaacgtgccgccttccttgattgtgtccttttacttgtttgatctaatgagtgagtgtttgagtgacaagaataggtatttttccatctcaagattcttaccttcttcttctctatattttttccttgcagggcaaccaggaccaaaggtaagggctttcttctttttcttttttcatatttttttggctttatattttctgcttcaaaagcaatgctatgttaatccagtctgtgattttttagacatcagaagatatctgtttcagagggtacctcaacacaggggctgctggcagggttttagactaggggcttagtgggcttactcggcttaatcctgtgaatgtttcatgtttcagggacagaaaggagaacctggagacatcaaggatgtaagtgcaaattattctcacccggtattcgacgtcgtcgtctaaatgggtcatttccttgtgctctcctctaacttaccatcctgtggggctctctctcacagattgtaggacccaaaggacctcctgggcctcaggtaagagagggagaaaatctctttctccgtcccttcctcgctgcgcaagttactgatctgtaactcctggccttgctgtcatcttaccatgttcttcaccttcagggacctgcaggggaacaaggacccagaggggatcgtggtgacaaaggtgaaaaagtgagtaaaaagcaatgctgcttgaccctggtggacttcccaggtcccccaaggccccaccatgtgtttaagggcctggtcacctcttaaagagcagccaagggacagatggctcttggagaaacactgcttcccattgatgcctttttctctttatgccaagggtgcccctggacctcgtggcagagatggagaacctgggacccctggaaatcctggcccccctggtcctcccggcccccctggtccccctggtcttggtggagtaagtatccttacttcccattccttcaggctgtccctccagaaatgtggcttttaaattgctgcttgcacttacctggctggctcccagggctgccagcagtgtgtacatagcctgtccatgggctttgctcaggcctgtaatttagaagagtcacatattaggcatgagactgtggtgctaagggctggcttttttcactaactgggattctataaagaaagtcctcagttacctggcttcctggcatctgtaccacgtagttgatgctggggggtgggtgtaagggataggaggaaggatgactgggcacttgtatttccctggaagacgagtgaccactgtccttggaagacatttatccttggttcttgccaagtacattccaagcaactattcactctcatgaaagagctccactgagtgaaggtgtgtggctaaagtcaattctggaatcaaaccaatcaacaaattatatgattgcctagtttttgcaggtttgctattttgatgtttgctgtattttaaattcttaaactcaaatgggatcacagatgcctactacatctcttgctgaaatattccaagactgttgattttagtcttttgctgggcactaaagtctaaagaataaagaacacccttagaaggtttggttatgtttctccatatacgttaaataacatctgtcatattttagagcataaaaataattttataaaatgaaatgcaaggaactgatacttcctcaaataacactttcccttccagtgaaatgattttgccactgtcatctaataatccattcccaaaattactttccaggcatcagtggtaattctgatcaatgataggttagtctccaacaatcagagtttatctcagtagagttctttgtatccatatagagacttacctagccaagtagggaagacctagtgcctttcaacctcctaacgttgttgggtttctttgcagaactttgctgcccagatggctggaggatttgatgaaaaggctggtggcgcccagttgggagtaatgcaaggaccaatggtaagaaaagacactagttctttgcagccaaaatggcaggaggtggcccttagcagagccagagagtctgacaacctctgctttacagataattgcttagagtggctctcctccgtagttatgtaacctcccattcagctagcccaaagcatttggtttttaatggcaatggatgccacttttaatgatgcgctggagtgactaagaagaatgaagatgggagatgcatataggctgatctgttagaaggccagttgctattgctcttggaatgagaactgaagaatgcagacagcagctactgttctccagcatccacagacttccagcaggccctctcagcccgcagctctgacttggcacatgctaaatgaaactcagcctttagtaaacatggctgctgtccaggagaaagcaaggccagcttttctgtccaaatggtgcctataaataaaaatagagtgttgcgtggggagtgggaaatgagagggagcagccactctaggccccttgcccacagagtaacttcttgtcctttgcccgggctgttggctgggagaagatggcacactggaggccactgaggaagcatgtgtagtaaacccctcattttctgttccgatgcagggccccatgggacctcgaggacctccaggccctgcaggtgctcctgtaagtatctgcaagtctttttgcctccatcgtgtcgcagatgattcccaagcactatgatgttttagcagtttatagggattgacctggtatcctcattttactttttaggggcctcaaggatttcaaggcaatcctggtgaacctggtgaacctggtgtctctgtgagtaccagcacggccctgtcccttctctgggggagcctctaatgatagaccactaggacgcagctgctgtccctcccagctctgcccagctctttcccacagtcggtggccccaaggaaattcggatgtcacttcctagctgtggaggaactctcacagacagcccaatgtggcaaggaccaccagggactctgtcctaacagcccctttggggtcaccccagcctgtgctatctgctgcaatcccactatgatctctgcacctttgctctgaccttcccatctttcttcttcatagaagaactggcattccaaaactacaatgtcaaagttttgtccattgcttaggtgtcttcccactataaccatctcttaaactatcttcctttgtttgtaagggtcccatgggtccccgtggtcctcctggtccccctggaaagcctggtgatgatgtgagtatacacgagtagacaaatgaggagctgcctcctttgaaagggcctggagagggtgtgtgcttggggagtgacagggaggcacccagggtggaggtatcttgaggagcaagactgggcagtcccaaaccctgacgccatctcctatctatatggccactgtgactgtgctggcaagttccctggggaccgctttggatccaaggggaagacaaataattaaaacatcattagccccaggaagggaaattgagaaatgagagaagggagagaaaaaatacaaggcagaaagatgtagagaaggaaaaacaaagaaagaagcgttcaacaacccagcattatcttaattgtaaatgagttagaaaaagcacagcctgagtcaggatgtctacaaaggatgcaaactgaaatgaagagacaagaattggcactcttgtcgtatttttatgaattcgattagacagtaaaagtctcttgaggttagagagagcacatacagtcagcagaacctaggagaggagagaaaagcctctcaggggaagttggaggctggtgaggacagaggagcttgcccatggcgtatgcatgtgtccaaaagaataaatggtgacccatgaaaggcatccaggcacgtggagtctgaaggaggtgagggagatgagtgagccggtacagaaggcatggagggctggaaggagggaagccctctgggtgcccccactatgctactgcgtctctgaggaagctgggatatctctctctctcccttcagggtgaagctggaaaacctggaaaagctggtgaaaggggtccgcctggtcctcaggtaaacgccaccgttcccagcctcaggcatctttcctagcgtctccctccctgtggccttaaacacagtgcatccagttcaatgaggtcacttctgagatgaaacgccagtagcccctatatttatcacgaccatgtttgtaatttccactcaggctctcatgagggaggctgggcagttgttatttataccactttgcataaaatggggggtacggggaggggtggtcgtggttttacagaaagagctgtccaagtgtggggattcgagacaacgccctggtggcgaagggaactggaggccctcctgcagccagggcagctttccactgttattttactctgtgctctgaacacctccactttggattgcagggtgctcgtggtttcccaggaaccccaggccttcctggtgtcaaaggtcacagagtaagtatcacgggtgagaaggttggaaggaagagatgcctggtgggagagaaaagcactttggggtgcgtgcatttcttccaacttgggtttcccagaagtctgattgaacattttctcttgttccctagggttatccaggcctggacggtgctaagggagaggcgggtgctcctggtgtgaaggtgagaggccagaaagtacaatgggatggggaggagggagacaatgaggagcccctcttcctagccagggagacactgtggagctcagtggaactagctcctcagaacagccttggctgggaacaccagccctacatcctgatgggccaacagcaggcctggagagctcagggcattgtccctcacaggactgaagtttgtgtcagtgcgagctgagatgaccagggcttttggcgtcttccctaggagtttgctggcggccaagaatggggtcccagacactgaccttgtgcatcatttttccagggtgagagtggttccccgggtgagaacggatctccgggcccaatggtaagtatggacaccctccaggaaggtttatccaaagactcttcagactatcagatggctgcaaagagctccctttgtgcaaagttcatattctgtgttgtagatttcatctgattgtgagcaaaaagcaaaatgtattagacagatgatttgttcaagatttcaccaacatttccttaagatagccatgttatcacactaaagatgctcccattttaaaaaattctgttgagtctcaacattttgtcaagctcatctactgcaaggagcaaggtgtgcttgtaacaaaggttcccaataggtagcaacaggaacattcgtgtgttccgcctgtggagaaactgttgggtgtgatctgaagcatcctggctagtcaaggagccagcaccatcaggaggtccttgttttcctgggtgtgggcatcctccctctcctctggtatccgcaaagggcctgcaggtagaaatggtcaccctgagcaccgtaaagccaactcatgcttaggctgtcctggtgtgtgttccagggtcctcagggtcctcgtggcctgcctggtgaaagaggacggactggccctgctggcgctgcggtgagtaattgacaaagccaaacaccaccatttgccgagcactttagagtttacaggtttgtttctcttgaccctcgaaacaaacctgtgaggcatagggagtattgctatcccttaagaattcaccccagggttccatcaaagcttccaggctgagtctcacagtgaaggaggaaggataggaatgggagggtcgatgggtgaaagcatgattctcttaaccagtccagattatcaggtaatcccttcaacaaccaccacccactccctgggcaatccagctggagtttacagacagacttagctggctatagcaccaccgtgctactctctgttcttcctggttgctcaaatgccctagaaaagtggaacaggtgagcatcaactcacagggctctatgctggctgctgctgcgagggatgttatgctatagtaccaggggccaccattccataggcacttcctgtgtttaataccctatagctttacttcatctcatcttcctccatatcctgagaggtggttctattcttctaccccattttacggatgaaaaaaccgagacacagaaaggtgaaactagcttaagataaatggtgccttgcagccttagactctggtggcctctagttaatgtgggaaattaagggtgaggggattggcagctgatggagggtgcagggtgccagacagaggcgtttagctctgatcccttagcaatagagagtccttgtaggcacttggtcaggcgagtgatgcgatgaaagctgtgtttaagaaagattatgctttctgctgatttcatacccccaacacccaagctctgaggcccctcctcacaggtccttgcagggctggccaaaataaagcagcttcactccgttgtgctgctttccagctaatgtgtctgtttggcagaagtttccctcaaaggcagatcagtgaaataagcagaagcctcgacccccctttgtcagccagagctgctgaagtgccttgccccagggtcactttgtgtgaggggattagagagcactggggctgccaagaaacactgccgtttctacagattagcaggacgctggcttgtggcttttagcgaggctcagagctgcggtggccctagtctgcatgggctaaagacaagctccatctcctgtcctttttccctccttcctgggcacagccgccctgcttcttggttctctctgttggttcctgtccgcacggtagttaggctggcagcgtgtgtaggatttggcttagaagattgacaacattgcctttgagcccttctttgctactcctccctctcccctcccatcagactcctctctggagtctgctctgcgaggcctctgctctgtggtatcccagcagccttctcagccttgacttccagaagggggctgtgcagtgtccggggtgtgcaggccccagacacggggtaggctcatggagatccaagtgctgatctagtgtcaaggctggcctggagactgggctgggttggtgtcagcctgctgtggtcatgtgccctcccaagggcctgtatcctctctccagacttgctgcagggagaggtggcagatgtcagcctagttctggcctctcagagcagcatggcagctccctttcactcaggcccaggctgggcctcctgctggctgaccctggggagagggtgctccagagcaccccaaggaacagcttcccgaagcagccaggccagcccagaggggctgtggccaatcctgaagctttatgttcctgctgacattttttctaagttttctcttgctttcctcttaaatgccaatctggagagtctccgttaggagaaatggaccccagccaggaagaagagttgagttgtatttaaaacacgagctccccctaaagcatccttctttagcttctaaggagaggcagagactgacaggcaggactcagcaggtaaaagtacccccctgacctgctcagtcagcctaggcccagctccacccagcctgtggggcccagagtttcggtaaagagttccctgggccttaaggaaccttgagagagcatttgaggggtgccaccacaaacttggcagaaaaaaccctccccctccaagtccagtcctagagaaggagctggcaaccttgccttgctttgtaagcaaaagcctcttagggcttgagtctagatgtagtgtttgagctgtggctggtgccctcccccatcagggagccaatggtagacatcctatgggcatctttgttttccgtaagagcaggctgctcggggatgggccagaggaagaggcaacctggagtcaaccaagaggaggccttaaccaagccttaaccacagaggttaaccaagccttgaaagcgcttccccctgagcaggccaggaagcactgagtccacatggttgcctcgctgtttcatttccttacactcaattctctcagtctttaaatgatcacttggccttgaagttacggatatttggggtctgaactgaagttgaagaaaagaggaaatgatttaagctttgtttaagattaggggccaggtgcggtcgtcacgcctgtaatcccagcaccttgggagcctgaggcgggtggatcacctgaggtcaggagttccagaccagcctggccaacatagcaaaacccagtctctactaaaaataacaataaaaaaattagccaggtgtggtgacacatgcctgtaatcccagttactcaggaggctgaggcagaattgcttgaacttgagaggtggaggttgtagtgagccaagaccgcaccactgcactccagcctggcgacagagccaagctccgtctcaaaaacaacaacaaaaaagattagaagaagcccattactgccttctggccacccactcgcacagacaccaaaactgcagcccacacctcgccatcctcgtgctctgccctgggacaccccaggcacagtgtgtccttcgttttctgtaagggtgggctgggagcagggacggacagggcctgtgggcacctctcatggtcacttccttcttgctcacagggtgcccgaggcaacgatggtcagccaggccccgcaggtcctccggtaagttcatttcatcctcagcaggtcattgttgctgtgctttaagtcccgttaagcagcccaaggcagtctcgagggtgtattgggtgcaaccacagcagcactctgatgtctactggaaagggggaggaaagagaagaagtttgtaaatatcaattgagcatatcgataacaagctttgaagcatgggctcattttcctcagccatcctttcagcagtctttttagaggagggaggtcaaaggagtttctgcttctcaccacagatgtagtcagaaacttgctttgccttctgaagccaggcaaagcttcctggggacgctggcaatggggacaattttcatccaaggccttttagccacaatggatatggagtgaaatcagtacagaggagggaaggagtgtgaggtgtcggggtcgctcgctttggaggccagaactggcattcacctctcttctcatccgcctactctctccagggtcctgtcggtcctgctggtggtcctggcttccctggtgctcctggagccaaggtacgtgccctgttgtccagtcaggaacttctgggtgccgagaagctgtcctttccccgtaacccttgctcattgctccctcaacaaccacctgctcccttctgagaagtagctccccaccaccccacccactggcccctccatccaggcagggcaaaaagccagacactcgcagtctcacctggagggaagtaagacagaagataaaatgtgggagatccagttacaactttggagtggggaaaggtggacagagaagaagacggggatacaccataggcctggcaggggcagaaggccaggagtggcagcacagggaagcaaacctaggggagacccaacagctgagcaagctcggccggtgacgggcatcggagggaactgggcagggaaaagggcacaggcaggagcccctgctccctctgggtttctgctttatttggggtgcctggctcttccaaaccatgttaacggagttctctggaggattactagaggccagtgggaggccagccagttcagggacaggcctcgcagcccaggaaggattccagtgtgaacgtccctgggaatgaataaggagcctccatgtgtcactggcatcaggttgcttttccctcctggggctttccatggcaaccagacagtgtctgaggtccggagccgggtgaaggagacccattgtgaagagggacagcggaaggtgaggggggctgacctttggaaaataataattaccacagtgaagcaggaatgttctgagaagaaacctgaggagctctgccctctctccaggtcagcagccctccccagggactctgccatctagagtgggttgtaattttcaggaaaaaatgaaagtaaaagcacaagccattttgtggggagggggcttgccagaggcgcccgctaaggggaattgggctgtattgagagcagggaggggcagagtccccatgtgcttttgccttggctttctggcttactgagaacagactggggccggagccagggtgtcactgttcacccatcagccagatgggagtgaggtggtgctctgagctgggatgttcagagacttagaagggacctcagctcctcaataaaatagaaaaacaggaggtgggggagagagcggtgtccgtccatcatcccacggtgccaggatggcagggtccccagcccacgcttttctgatggtgtcgatggaacagcaggttgcccattgctgtagtatgtagctgtgccgtggcatgtggaggctcactgtgtagagatgaggtaagcagtagaggaggcaggcgtgggaagtcatcaagtcatcagctcggtcaggcagggagaaaaacggcagcgtgaactgtgtgtgaaccgacatgttcatgtgcagggttgggtgcatgtgcataatttagtgctgtcgttgcagctggaccctgagctattgcccacccactagaggtctgtgtcccctctcttcttcttcatttcatacctccctgtctcttcccagggtgaagccggccccactggtgcccgtggtcctgaaggtgctcaaggtcctcgcggtgaacctggtactcctgggtcccctgggcctgctggtgcctccgtaagtgcagcttctctttggcctgggggggtctggggtctgtggctttggaactcttgactctgtactttgctctgacagttgtgggctccaaccaccaaaccttcattctggcccaatgcctgtcccacctctagatgtattcccttctatcccatcttccccttgaaacacatagtgggaatgtccctgaaatggacagcacctatgccaggtccctggatctggatcctggagggctggaggtggttggggttcattctttgctgcttatttgacaatgtctcccttttcagggtaaccctggaacagatggaattcctggagccaaaggatctgctgtgagtgttgcccgtggactttgctaccccaggagagcccagtcctgcctctcccctctcctgacacccctcccttcttctcatgcccacagggtgctcctggcattgctggtgctcctggcttccctgggccacggggtcctcctggccctcaaggtgcaactggtcctctgggcccgaaaggtcagacggtaagagcccaaagtgacccccaagttccactgacatctctggagtcaaaccccatcacccctctttcccatgctctcctgccctggcctcacagcggcctccatccgagggcatcttgaacaggggttctggggaggggcaggctccctggagagaatctggtgtgaggacctgcctctcttttcaagggtgaacctggtattgctggcttcaaaggtgaacaaggccccaagggagaacctgtgagtatctgcccccaagcccttgtcttctctgctgctgttctatgaggcacagcctcagccccactgacccaccacctccctcctccagggctctatcccccaatctgggtcctttcagattatgcctggaggagacttaactgggctgagaaggcccagatacagcttcagctcccatccttggtttggctagtgtgaacagttggatctttagcccctctcacttccctctgccctgccatggctcgtcctttatgcctggaggagacttaacagggactgagaaggcccagatacagcttcagctcccatccttgggttggctagtgtgaacagttggatctttagcccctctcacttccctctgccctgccatggctcgtcctttatggcctctcgtcctcaagcccccccccagccctgaaacagttgccaaggctacttccttcatactctagatcgaggcttgctccaaggccaggtgaaggctcactctgtttctcttttttgctggtcctcagggccctgctggcccccagggagcccctggacccgctggtgaagaaggcaagagaggtgcccgtggagagcctggtggcgttgggcccatcggtccccctggagaaagagttaagtgaatgtggaggctccatcccatggggcctgtgacctcgagagggaagtggagtccttgtggtccgtgttctggtcaagtcccgtgacttttccgcatgtcatcctcctctttctccatcctctccgcgggagagggagtctgatcccgagttgtgccgccaaccaccagactgacatgaaatagtctgagctccttcccaggaagcggggcaggctccagaagttaacctctgagaatcctgcaggccacagctgctccccagaaattggggttggtgggttagtgggatggacccactggagcctggctgggttgggctgttctcactcactgcctctcctccctgtggctccttagggtgctcccggaaaccgcggtttcccaggtcaagatggtctggcaggtcccaaggtgagtgggagaagaggggctggggtcctccctgcatcgctgaggtcacatggtatcccactgactccctgtgtacccttgtagggagcccctggagagcgagggcccagtggtcttgctggccccaagggagccaacggtgaccctggccgtcctggagaacctggccttcctggagcccgggtaagtagcagagctgctgttgcccttggcttcagaccctcaggcccttcctggctggctccttccagccctgcactgccaggattgggaggtcctggggccggctcctgaccccaccctcttctctctcctgaacaaagggtctcactggccgccctggtgatgctggtcctcaaggcaaagttggcccttctgtaagtctatcctctgagggctgctaggagggtggggggatctccctggggaagcaagggaaaagagagatggagtttgggttagggaggcctgaagtactgtgaattttgagaattgtgacgagggggtagatggtaggcactggggccagatgtaacctgtgcagtagctgtgagcactgaaaatgccaccccagtatgcattcggggcttatccttgggggaatgatgacatcgtgtgtgcactttctggggcagctttctaagctcagcggtgtcttgttgtagatgggcccatgggtgtgatgtggtcaatcctagatgctgagcatgtgtggctggtgccatgtcctggcctgccatgtaggcccttagtggatgttgggtggatggatgtggtcagagtgtctatgttctgagaatggtgttctgtctttcagggagcccctggtgaagatggtcgtcctggacctccaggtcctcagggggctcgtgggcagcctggtgtcatgggtttccctggccccaaaggtgccaacgtaagtaataatttgctcttctatttccttccatgtggtgctacctacctccctgccctcttggggaaagggctgggtcctgagtagagtttacccagggacagtgatgagtggggctcctgtgccatgggtggcagtgggggtctgtatgtgatttggggaaaatccatggccccacagagcctcggggcattgcggccataattgttccatgtggcagtgccagcaggctggttgccattatggcccctgaacagaagagaagggctgatactttgctttatcttggctgtccatcaggatgtggccccaggctcagtccctgcagcccgctctgcccccaactccctcccaaaccatccgcctcatggccctgccctctctttccttcagggtgagcctggcaaagctggtgagaagggactgcctggtgctcctggtctgagggtaagtatccttccccgctgcccatgacttggtggtggccgggcatctgcagggaggacaggggaacggcctccccatggcatggtcccgggacccctcagtattgagtgttgatctctgtggctagaccccatgctggctgggcctttgggtgtctacacagggagacttctgtttgccattggtcagcaggccggggagctggggaaggcttccatgctgagaacagctaagaaaagacggggccctgggaaggaagggaggggaaggtgtggaaatggagctcagctggggtaccgtggaggtctggaaactctgggccagaagtacctttgcccaatcctagggggactgcaagcgggaagaaaagcgtgtcattggacttttctttttctcttctgtctagggtcttcctggcaaagatggtgagacaggtgctgcaggaccccctggccctgctgtaagtacctgcccagcctccccaggtggccctgggggcaggggctgggaggggtgggggtgggagagcccatccattaatggagctgacagatgtgaatgtgggctgagctgatacaccagactcactctgagctgaggcagggtgtcccaggaggctgtgtggacccacattggtggagaggagtgtgggtggctgatgggagtgcagggaggcatgcatgcactgtctgagtggtgcaggaagacgcctgtgctgcccaccctgctgacctcccctgggccctactagctgtggctctcagggtctctggaacactggctcagctcaccttttcttttccactgcagggacctgctggtgaacgaggcgagcagggtgctcctgggccatctgggttccaggtaggtggctggaccaggctctctgtgtcagtcctttgccatacccagggctccctggacagcagcaggcactatcggtggagggcccacacctcttgcagtgtccaggcatcgagccttccctgcacccctggctgtcactgctgctgcttcctttctttgggtctgccctatactgtgcctccctgggggccagggcagcaaactcactcctttgctaacgcttgtcacttcggcttctagggacttcctggccctcctggtcccccaggtgaaggtggaaaaccaggtgaccaggtgagtatggggctctttggacctgcaacctgtttagatgggaaggtcttttctgatgcctaggaggcaagggcaagagggcatgaggagcctgtgaggcctgggaatgtctggacccatgtcccagcctccacagatgacacaatcccatggaggagtgatattcagccctgctgtggagaattgttcaggggtctgtgatatgaagccttcactctcacacatctttctttgttctccagggtgttcccggtgaagctggagcccctggcctcgtgggtcccagggtgagtatcctgttggccaatgcgggctgcctccttgggcctgccctgggtcctatgctcctgctcctttccccacctccctgcttctccctggaccttctcccccactgctgttggttgatcacttcttggtgtctctgccgcagggtgaacgaggtttcccaggtgaacgtggctctcccggtgcccagggcctccagggtccccgtggcctccccggcactcctggcactgatggtcccaaagtaagtgaggctgcatccagtaggggtcttcgtggtagcctggagtcccactgagcaggagagaggagcgggctcaggaggaatgaagaacagaagtggggggagctggaaaggaggtctacatgggaggaagggaaggaagaggggtttggggcctggttacccaggctccatgaacatgggttcagggagaggtgctgtccactacagactccctcttacctccctccccagggtgcatctggcccagcaggcccccctggcgcacagggccctccaggtcttcagggaatgcctggcgagaggggagcagctggtatcgctgggcccaaaggcgacagggtaagtactgaggttacagcctcctcaccaaagctgtggctttgccaatgtcctgccccttgtgatcgcttccgttcccttatggcacctggtgatgaaggtttctgttagccctttttgaggagcttaaagactcctttccaaagctccctgccttttagtgacatcctttcccctgttccttcatctcacccctgctgctcctcacccaccctgagaccacagcaaattcctcttgggcagggactgggctttccctagcaccccagcctgggtgggactgagcaaaccatgggggtcctggggtgcctggctgaggcggctggttttctcttccctcagggtgacgttggtgagaaaggccctgagggagcccctggaaaggatggtggacgagtaagtgaatgcgggctgctggactgctgggcattaggatcctagccctgcacccaggagagcaggagagagggtctgggcagtctgccactggggtccctggtcctgtctctgtcggggctgggcaactgcagggacttctctgttaaaatggggccagagggtaagtgggagctctggaggcggtgggagcacgcaccaaggttggcttggtgccgggccgcacgtgctcggctggctcagcctgcctccctcacctctacctgctctccccgcagggcctgacaggtcccattggcccccctggcccagctggtgctaacggcgagaaggtgagtcccggctcctttcctctccacaccttgcctccctgtcacacctccttcttatctcctgccaaaggggttctgtcttctcctccctcaccactgtcaccctcggccaagggctaggagtgaagagggggccctctcagaagtgaagccgctggcagtgttccctgttgggtggggcaactgggctggggtaaacacacattcagcagaggccctcgagagggtgcgggtatgggctgcacagtaacacaggctgtgcagggggacctggagcccccttcccacgagcaaggccccccaaatgcactttgccctctcccactctgcctccccaccttcttaccccagctcttcctcccttccccaccctcagggagaagttggacctcctggtcctgcaggaagtgctggtgctcgtggcgctccggtgagtgtctgcccctctgagcctggctctgccgaggcccctgggaaccagagagccagggagtcagtgcaggccctcatgctgcctggtggccctgtgtgctgccaggcactcggtccctccctacccgctgggtctagggtgggaggagagatgggaagggaagggggaaggcacgtcactcccatcatgtgttcagggtgagggcttttgggttaacagagcctctgcctgcgttcaggactaagggctgctttcagatccccgtctctggggaacaggaggctgggcagggccacggggctcttggaggggagcagaagcaggtcaggcagcggggcctgactctcgccatgcccccttctctcacagggtgaacgtggagagactggcccccccggaccagcgggatttgctgggcctcctgtgagtatctctgtccatcctcctgggtacctccactcaggccagttccacatccagcaccctcgggcatcggagcttgtcagggagggaaatggatgctcctctcctctcctttcccgcctccatactaatagaaccatcatgtccagaccaggacacacacgcagatactcacagagtctcccgctcttctggaagagctccagggttttagcctgcccctcattcacctgcttcctccttccccattatagggtgctgatggccagcctggggccaagggtgagcaaggagaggccggccagaaaggcgatgctggtgcccctggtcctcagggcccctctggagcacctgggcctcaggtgggtaacgctgcactccaagaattgttccctcaaggaagggctcctggcgtgcagatgggaaggccccagcaggctgcgcagaggatggttcgcaggcctgggaacacccccatgttggtagaaggagcttccatgtggcatgtgggctgtgtgggtggggtgtagggactgacagagtacaggctggccacagccagccagaaccaagctgctgatctcctggggaggagggggcggtggcaggaagagcttcccgggaggccagaccccagaccggttctgtggttgcctgacaggcttctcctagaacacaagtctcctgtggcagaggggacagagctgcctgtggacgcctcttcaggctgggtttttagtgccaagaaagctgcatcttcgaaaacctcaggggtccattgttggggctcagacagaagcccaccgtcttccttgggccactgggcctcactgtctccctctttcctttccagggtcctactggagtgactggtcctaaaggagcccgaggtgcccaaggccccccggtgagtgaggcctctgacaccccaccctgcacctcacaaagaggcctggccccagaggctcccatggcggggggtgttctgggatgcccccgactgttttcccagccctgcgttggtccccagcctaagcccacccacagccaggtgggagagagggcgcctgtgggctgggtgcactgtggtcccggattccccagcccgaggcttgtccctcgttcagctacctgaagtgctgactgtggaaaccggagcagggaaacagcctgtgcctgcttctatgaccagacccgggggccctttctccctccctggatcccccttgcgggcttgggatccctcgccctttccataccaggctctgagaccacccccgccccccgcccattttaatctcaaacctcctgagggcttgaggttctcaggggctctcctctccccacacagggagccactggattccctggagctgctggccgcgttggacccccaggctccaatgtaatggatgctcctggcatgagaggcacaggcaggcatggaatagcctggcccagcacccaacaggtctggagagctccaggctggccttcactcctctgagtccgttcctgccccctggaggagtagctaactgatcatggggacctatcccctgagggtggctgggggcagggttgtggccctgctgtcagcaatgggtggctgccctgctggcttggtgggcaggacagggctgccatgattaccttcatcctggacagatgtttcttgagcatgttctgtgcacttgtctgtgtgctttaaagcaagtccgcatgtcctgggtcgctctcagggagtttgcatggagggagcagtggtgatgaactcactgggttcaccagcgccataggcagagggagcgagtgctgggggcaagctcaggggtcagaggggctgggctggagcggctcctgaggaagggggattgaggacaaagggaggagggaggagagattccaggtagatgggagaaagcaagcaggagctggagaagttggggctgtctgcccagagctgtctcacatggtgagaaggttgcagcggtagattggggttgggggggttaagctgcctgcccttagtgtggggaggtagagaagcccccagagaggaaactgctgtcactgaggccacagtgactttggcagcctggatgaggaagggtgagatgagtcctcacttcccgcattttctccttctagggcaaccctggaccccctggtccccctggtccttctggaaaagatggtcccaaaggtgctcgaggagacagcggcccccctggccgagctggtgaacccggcctccaaggtcctgctggaccccctggcgagaagggagagcctggagatgacggtccctctgtaagtccctcaccaggcccatgccaaggtccctgggagcagggtcgtgagtggcttctgagctcacagagcatggggtaggagggagcaggggccgtggggatgccagggagcggggctgcacagacagagctgtgctgagaggacgaagaggctgggccactgtcagttctcatctcctgcctctcctctctcagggtgccgaaggtccaccaggtccccagggtctggctggtcagagaggcatcgtcggtctgcctgggcaacgtggtgagagaggattccctggcttgcctggcccatcggtgagtgtggggtatccctccctccatccaagctggccctgcctgccaaggcttctacctccctcagcaccctcaggactgtcccttgtctgccctctcctgaagggtcagtgggccctgggcaggggtgcttaccacttgcactcatcatccttgtctctgtcctccagggtgagcccggcaagcagggtgctcctggagcatctggagacagaggtcctcctggccccgtgggtcctcctggcctgacgggtcctgcaggtgaacccggacgagaggtgagcagtgagaccccctggggtggccctgattggggagaggggccctgtgagtctctgtgctgggtcagcaaggacaagccccagtcagggcctcggagaagggggcggcagcgctggccgacaggcgaaagcctaggtacaatgggaaggttgtcggggagagagacgggcatagagaccaagggctgcttctggaaggaggagggaaacttggtgaggaaactttggcttcaaagtgtgagtgagttgggcagaagaggagaggcctgggcttctgagaggggctgggggagcagagggggaggtgggcaggaagcagctctaagtgcattcttgtttcactttgtccagggaagccccggtgctgatggcccccctggcagagatggcgctgctggagtcaaggtgagtgtctggtgtctgtgtgtgcagtgggttggggaggacattgcctcgggcctgacaggtcagctgggggtggcaggttggaacaagtctcatctcagcctagaaggaccttctgttcctgtctcttctggaacattcttctctgagcctgagacctctctcctgacagggtgatcgtggtgagactggtgctgtgggagctcctggagcccctgggccccctggctcccctggccccgctggtccaactggcaagcaaggagacagaggagaagctgtaagtatcctggaattcagtaaaagccgccttcccctgcgcggtggggctgaggcagtccctgggtttccgcagtctctggactaaggagcagtggcctcagatgcagaggaggcccccacctgtcctggcttttctctgacgctgcgctcactctctcctcagggtgcacaaggccccatgggaccctcaggaccagctggagcccggggaatccaggtgagtatccaagtgtcctgcactgagtccccaccagggataggctgggagggcagccagcctccaggtggttcctggcctccagccctgtgtttccggggattcctcagcttgggtgggacaggagggggctcctgtcctggccctgacctgactcaatcggtgtctgtcttgttcccagggtcctcaaggccccagaggtgacaaaggagaggctggagagcctggcgagagaggcctgaagggacaccgtggcttcactggtctgcagggtctgcccggccctcctgtgagtgtcactgcctgcgtgggacttcccgaggcctcctgccacacagagcccacttgagctccctgtgctgccaggacagcttgggatcaccctaagcagtttctaggatttcctcagggctggagggaggaggaagtggaaagggaatggggctgggacataaagctgttcccccagctcccagaatatagatagatatgtctgtgctgaccgtggccttttgcctcttccttctacacagggtccttctggagaccaaggtgcttctggtcctgctggtccttctggccctagagtaagtgacatggagttggaagatggagggggcccttcagagagtgtgggcctgtgttcccatggggagggaaatgctgctgcttctggggaagctgtgggctcaggggtcctcactcagtaatgggggcaggactggctcatgtgcctatggccagaaaagcgcctgaggccacaatggctgtaagacaaacatgaatcagcctctcgctgtcagacagaacagcattttacaaagaggagcttaggagggtaggcaagccatggagctatcctgctggttcttggccaaatagagaccaacttagggttccatgactgagcatgtgaagaactgggggcggagtggctggtgctatcaggacagccacctacccagccccagcgactccccagccttccctgtggtgaccactctttcctcacgacctctctctcttgcagggtcctcctggccccgtcggtccctctggcaaagatggtgctaatggaatccctggccccattgggcctcctggtccccgtggacgatcaggcgaaaccggtcctgctgtaagtgtcctgactccttccctgctgtcgaggtgtccctaccatccgggaggcttgagctcttttttgctcagggcctcttttagggcatcagcctgcagctaacagtgatggcatcctttatcctgaggtctcctcagaggtcacagggcccatgatcagtgctgggaaactgaagagaagggctaaggaagaaatagacatggtgctgtggtttccttggtcctcgcctgctacacctccgccccacccatggggctgggaagagggacactctagtacattctagcaaatggggatggacatggaggggcactttcacacaatcctggctgatctctctgtttcctgctgcagggtcctcctggaaatcctgggccccctggtcctccaggtccccctggccctggcatcgacatgtccgcctttgctggcttaggcccgagagagaagggccccgaccccctgcagtacatgcgggccgaccaggcagccggtggcctgagacagcatgacgccgaggtggatgccacactcaagtccctcaacaaccagattgagagcatccgcagccccgagggctcccgcaagaaccctgctcgcacctgcagagacctgaaactctgccaccctgagtggaagagtggtaagcttggagaacaggatcccctgccccgggaagcagggagtcatcccttaggcctagcagcaagggaggagatgccccctagtacagggcagagctgggcctggaagtttccgccagagggttcctctcttatttcacagcagagaagctgcagccctggcccctgtcctgccatggctacctggccgaggtgacctcagggtggactccatccaccagctgggcactgcttctgctctctttgcatgtgttcttccttagggctggacttagctcatgcagatctccctgcccctgcatcctcccaggtccccctcctttcaggccacatgtgaacctcatcccttgtccctgtaggcctctctgtctctttcagtcaggcctgggtctctcaagcttttgtgtctgtgcctgtctgagcccccatgggtgctgcctcttccccctgcaggagactactggattgaccccaaccaaggctgcaccttggacgccatgaaggttttctgcaacatggagactggcgagacttgcgtctaccccaatccagcaaacgttcccaagaagaactggtggagcagcaagagcaaggagaagaaacacatctggtttggagaaaccatcaatggtggcttccatgtgagtacctgggtgccctagatgatgagcagagatggctcctcaaactctttcttttctttctccctggaagcttttagcaccttccccatattttcctccagttttctgttgggcttgagaggagggaaagaggaggaaaagtattttttccccacgtggaggtgggaaaagaggtcctctgagcttgctccactcctggaagcaaaaatgtccaactagctccctgctgccccagtacccttgaggtccttgaaccatgaactcttggcagcccctacagcccctggtcccattgaatgccagctcccaggcctcacactgccgctctctgccccaacagttcagctatggagatgacaatctggctcccaacactgccaacgtccagatgaccttcctacgcctgctgtccacggaaggctcccagaacatcacctaccactgcaagaacagcattgcctatctggacgaagcagctggcaacctcaagaaggccctgctcatccagggctccaatgacgtggagatccgggcagagggcaatagcaggttcacgtacactgccctgaaggatggctgcacggtgagtggggctgccagagagaagagctgcctgtgcccaaactgcctggagcagggctgagggttggcccgcggcagctgtcaggtcctaaagtgacaggatcatcagaggcatgagtttgagggtcatgtagagaagataggctgagtgacaggtgagagagaggcacatatcattccatcttctccattcccctggctcaggggaacaaaaccctacctggaacccagtgactactgtagaagtgttctcgcaatgtgtacagggtgaagaagcggtcacaggttgggagctcactgtggggagtggggaaggaggggaagggcagggtggagaagggccctgccgctaaggataggagttgaagtggagaggcctttggcaagccaagaagaggtctcaggagccccctcagtgtggttcaaccttgtgggctctgatgctcgccagtttgttcagttttgggcttctgggcagctggaactgggtagcaaggcatctactgaacagagcctcctccttttttctcccctagaaacataccggtaagtggggcaagactgttatcgagtaccggtcacagaagacctcacgcctccccatcattgacattgcacccatggacataggagggcccgagcaggaattcggtgtggacatagggccggtctgcttcttgtaa

SEQ ID NO: 146 - DNA, 28 bp, artificial sequence
  COL2A1 forward primer
tctaacaattataaactccaaccaccaa

SEQ ID NO: 147 - DNA, 25 bp, artificial sequence
  COL2A1 reverse primer
gggaagatgggatagaagggaatat

SEQ ID NO: 148 - DNA, 36 bp, artificial sequence
  COL2A1 probe oligo (6FAM--TAMRA format)
ccttcattctaacccaatacctatcccacctctaaa

SEQ ID NO: 149 - DNA, 36 bp, artificial sequence; identical to SEQ ID NO: 148
  COL2A1 probe oligo 2 (6FAM--BHQ-1 format)

SEQ ID NO: 150 - DNA, 20 bp, artificial sequence
  ESR1 transcribed exon 1_2
cggcattctacaggccaaat

SEQ ID NO: 151 - DNA, 21 bp, artificial sequence
  ESR1 transcribed exon 1_2 reverse primer
ccttgtcattggtactggcca

SEQ ID NO: 152 - DNA, 24 bp, artificial sequence
  ESR1 transcribed exon 1_2 probe oligo (6FAM--TAMRA format)
tgccaccctggcgtcgattatctg

SEQ ID NO: 153 - DNA, 20 bp, artificial sequence
  ESR1 alpha upstream transcript A forward primer
taacctcgggctgtgctctt

SEQ ID NO: 154 - DNA, 18 bp, artificial sequence
  ESR1 alpha upstream transcript a reverse primer (6FAM--TAMRA format)
gcagggcagaaggctcag

SEQ ID NO: 155 - DNA, 18 bp, artificial sequence
  ESR1 alpha upstream transcript A probe oligo (6FAM--TAMRA format)
ccaggtggcccgccggtt

SEQ ID NO: 156 - DNA, 19 bp, artificial sequence
  ESR1 alpha upstream transcript B forward primer
cagcctctatccagcagcg

SEQ ID NO: 157 - DNA, 20 bp, artificial sequence
  ESR1 alpha upstream transcript B reverse primer
cagggcagaaggctcagaaa

SEQ ID NO: 158 - DNA, 22 bp, artificial sequence
  ESR1 alpha upstream transcript B probe oligo (6FAM--TAMRA format)
cgacaagtaaagtggcccgccg

SEQ ID NO: 159 - DNA, 23 bp, artificial sequence
  ESR1 alpha upstream transcript C forward primer
ttctggaaagacgttcttgatcc

SEQ ID NO: 160 - DNA, 16 bp, artificial sequence
  ESR1 alpha upstream transcript C reverse primer
cccgcagggcagaagg

SEQ ID NO: 161 - DNA, 20 bp, artificial sequence
  ESR1 alpha upstream transcript C probe oligo (6FAM--TAMRA format)
agaaaccggcgggccaccct

SEQ ID NO: 162 - DNA, 25 bp, artificial sequence
  ESR1 alpha upstream transcript D forward primer
tctttacccttcttcacctgagaga

SEQ ID NO: 163 - DNA, 17 bp, artificial sequence
  ESR1 alpha upstream transcript D reverse primer
cgcagggcagaaggctc

SEQ ID NO: 164 - DNA, 19 bp, artificial sequence
  ESR1 alpha upstream transcript D probe oligo (6FAM--TAMRA format)
ccagtggcccgccggtttc

SEQ ID NO: 165 - DNA, 28 bp, artificial sequence
  ESR1 alpha upstream transcript E forward primer
ttaatctgaactttgaaccatcactgag

SEQ ID NO: 166 - DNA, 18 bp, artificial sequence
  ESR1 alpha upstream transcript E reverse primer
agggtgcagaccgtgtcc

SEQ ID NO: 167 - DNA, 22 bp, artificial sequence
  ESR1 alpha upstream transcript E probe oligo (6FAM--TAMRA format)
cccgccggtttctgagccttct

SEQ ID NO: 168 - DNA, 20 bp, artificial sequence
  Tata Box binding protein forward primer
cacgaaccacggcactgatt

SEQ ID NO: 169 - DNA, 22 bp, artificial sequence
  Tata Box binding protein reverse primer
ttttcttgctgccagtctggac

SEQ ID NO: 170 - DNA, 25 bp, artificial sequence
  Tata Box binding protein probe oligo (6FAM--TAMRA format)
tgtgcacaggagccaagagtgaaga

SEQ ID NO: 171 - DNA, 78 bp, Homo sapiens
  misc_feature (929)..(1007): ABCB1 genomic sequence corresponding to amplicon
cgggccgggagcagtcatctgtggtgaggctgattggctgggcaggaacagcgccggggcgtgggctgagcacagccg

SEQ ID NO: 172 - DNA, 86 bp, Homo sapiens
  misc_feature (1953)..(2038): ARHI gemomic sequence corresponding to amplicon
gcgcaagcggaatctatgcctgttacccacactccctgcgcccccgcaccccgctcctgtgcgcaagtcggaatataaaaccgcgg

SEQ ID NO: 173 - DNA, 84 bp, Homo sapiens
  misc_feature (215)..(298): BCL2 genomic sequence corresponding to amplicon
tcccgggacccggtcgccaggacctcgccgctgcagaccccggctgcccccggcgccgccgcggggcctgcgctcagcccggtg

SEQ ID NO: 174 - DNA, 103 bp, Homo sapiens
  misc_feature (1680)..(1782): CDH13 genomic sequence corresponding to amplicon
aactccgctcgttctgtgcgttctcctgtcccaggtagggaagaggggctgccgggcgcgctctgcgccccgtttctgcattcggatcgcccggcacgggcag

SEQ ID NO: 175 - DNA, 86 bp, Homo sapiens
  misc_feature (2905)..(2990): CYP1B1 genomic sequence corresonding to amplicon
gtgcgcctggacgggagtccgggtcaaagcggcctggtgtgcggcgcgccccgccccccgcaggccccgccctgccaggtcgcgct

SEQ ID NO: 176 - DNA, 101 bp, Homo sapiens
  misc_feature (2784)..(2884): ESR1 genomic sequence corresponding to amplicon
ggcgttcgtcctgggactgcacttgctcccgtcgggtcgcccggcttcaccggacccgcaggctcccggggcagggccggggccagagctcgcgtgtcggc

SEQ ID NO: 177 - DNA, 100 bp, Homo sapiens
  misc_feature (1146)..(1245): GSTP1 genomic sequence corresponding to amplicon
gccggcgccgtgactcagcactggggcggagcggggcgggaccacccttataaggctcggaggccgcgaggccttcgctggagtttcgccgccgcagtct

SEQ ID NO: 178 - DNA, 94 bp, Homo sapiens
  misc_feature (811)..(904): PGR genomic sequence corresponding to amplicon
ctacaacccgaggcggctagtgctcccgcactactgggatctgagatcttcggagatgactgtcgcccgcagtacggagccagcagaagtccga

SEQ ID NO: 179 - DNA, 146 bp, Homo sapiens
  misc_feature (6779)..(6924): PTGS2 genomic sequence corresponding to amplicon
atccaaggcgatcagtccagaactggctctcggaagcgctcgggcaaagactgcgaagaagaaaagacatctggcggaaacctgtgcgcctggggcggtggaactcggggaggagagggagggatcagacaggagagtggggacta

SEQ ID NO: 180 - DNA, 65 bp, Homo sapiens
  misc_feature (18107)..(18171): RASSF1A genomic sequence corresponding to amplicon
attgagctgcgggagctggcacccgctgggcgcgctgggaagggccgcacccggctggagcgtgc

SEQ ID NO: 181 - DNA, 94 bp, Homo sapiens
  misc_feature (304)..(397): SOCS1 genomic sequence corresponding to amplicon
gcgccgagcccgtgggcaccttcctggtgcgcgacagccgccagcggaactgctttttcgcccttagcgtgaagatggcctcgggacccacgag

SEQ ID NO: 182 - DNA, 148 bp, Homo sapiens
  misc_feature (549)..(696): TFF1 genomic sequence corresponding to amplicon
caaggtcacggtggccaccccgtgagccactgttgtcacggccaagcctttttccggccatctctcactatgaatcacttctgcagtgagtacagtatttaccctggcgggagggcctctcagatatgagtaggacctggattaaggt

SEQ ID NO: 183 - DNA, 78 bp, Homo sapiens
  misc_feature (256)..(333): TGFBR2 genomic sequence corresponding to amplicon
gcgcggagcgcagccaggggtccgggaaggcgccgtccgtgcgctgggggctcggtctatgacgagcagcggggtctg

The invention claimed is:

1. A method for predicting overall survival or disease-free survival following adjuvant therapeutic treatment of a human subject having primary breast cancer, comprising:
   obtaining, prior to or during adjuvant therapeutic treatment of a human subject having a primary breast cancer, a biological sample comprising breast cancer cell genomic DNA from the subject, wherein the adjuvant therapeutic treatment comprises treatment with tamoxifen or estrogen receptor antagonist;
   treating the genomic DNA, or a portion thereof, with one or more reagents suitable to distinguish between cytosine and 5-methylcytosine bases;
   determining, based on the treating, a methylation state of at least one CpG dinucleotide sequence of nucleotides 2905-2990 of SEQ ID NO:9; and
   determining, based on the determined CpG methylation state, that the human subject has an increased likelihood of overall survival or disease-free survival following adjuvant therapeutic treatment if said CYP1B1 sequence is methylated, and that the human subject has a decreased likelihood of overall survival or disease-free survival following adjuvant therapeutic treatment if said CYP1B1 sequence is not methylated.

2. The method of claim 1, wherein the adjuvant therapeutic treatment comprises treatment with at least one agent selected from the group consisting of tamoxifen, toremifene (chloro-TAM) and droloxifene (3-OH-TAM), ICI 164,384 (N-(n-butyl)-11-[3,17 beta-dihydroxy-estra-1,3,5(10)-trien-7 alpha-yl]N-methylundecanamide) ICI 182,780 (7alpha-(9-((4,4,5,5,5-Pentafluoropentyl)sulfinyl)nonyl)estra-1,3,5 (10)-triene-3,17beta-diol) (Faslodex), and (2-(4-Hydroxyphenyl)-6-hydroxybenzo(b)thien-3-yl)(4-(2-(1-piperidinyl)ethoxy)phenyl)methanone (Raloxifene).

3. The method of claim 1, wherein the primary breast cancer comprises at least one selected from the group consisting of ductal carcinoma in situ, invasive ductal carcinoma, invasive lobular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

4. The method of claim 1, wherein determining, based on the determined CpG methylation state, that that the human subject has an increased likelihood of overall survival or disease-free survival is based on the extent of CpG methylation of said CYP1B1 sequence.

5. The method of claim 1, wherein the one or more reagents suitable to distinguish between cytosine and 5-methylcytosine bases comprises a solution selected from the group consisting of bisulfite, hydrogen sulfite, disulfite, and combinations thereof.

6. The method of claim 1, wherein determining a methylation state comprises use of at least one method taken from the group consisting of oligonucleotide hybridization analysis, Real-Time detection probes, and oligonucleotide array analysis.

* * * * *

UNITED STATES PATENT AND TRADEMARK OFFICE
CERTIFICATE OF CORRECTION

PATENT NO. : 8,367,336 B2  Page 1 of 1
APPLICATION NO. : 11/628390
DATED : February 5, 2013
INVENTOR(S) : Widschwendter et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 886 days.

Signed and Sealed this

First Day of September, 2015

Michelle K. Lee
*Director of the United States Patent and Trademark Office*